United States Patent 12,508,308 (INFLUENZA mRNA VACCINES) - sequence listing, part 29

SEQ ID NO: 108041 - RNA, 1410 nt, Artificial Sequence
  derived and/or modified sequence opt2 from neuraminidase__InfluenzaA__ACI26574
augaaccccaaccagaagaucaucaccaucggcuccgucucccucacccucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaucaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucaacaaccgccacuccaacgacaccguccacgaccgcacccccuaccgcacccuccucaugaacgagcucggcguccccuuccaccucggcacccgccaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 108042 - RNA, 1410 nt, Artificial Sequence
  derived and/or modified sequence opt2 from neuraminidase__InfluenzaA__ACI26585
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacguccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 108043 - RNA, 1413 nt, Artificial Sequence
  derived and/or modified sequence opt2 from neuraminidase__InfluenzaA__ACI32764
augaaccccaaccagaagaucaucaccaucggcuccaucuccauggccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108044 - RNA, 1413 nt, Artificial Sequence
  derived and/or modified sequence opt2 from neuraminidase__InfluenzaA__ACI32765
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacaacaccugggucaaccacaccuacgucaacaucaacaacaccaacgucgucgcccgcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuucaugacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108045 - RNA, 1413 nt, Artificial Sequence; identical to SEQ ID NO: 105898
  derived and/or modified sequence opt2 from neuraminidase__InfluenzaA__ACI32766

SEQ ID NO: 108046 - RNA, 1413 nt, Artificial Sequence
  derived and/or modified sequence opt2 from neuraminidase__InfluenzaA__ACI32767
augaaccccaaccagaagaucaucaccaucggcuccaucuccaucgccaucggcaucaucucccucaugcuccagaucggcaacaucaucuccaucugggccucccacuccacccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108047 - RNA, 1413 nt, Artificial Sequence
  derived and/or modified sequence opt2 from neuraminidase__InfluenzaA__ACI32768
augaaccccaaccagaagaucaucaccaucggcuccaucuccaucgccaucggcaucaucucccucaugucccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108048 - RNA, 1413 nt, Artificial Sequence
  derived and/or modified sequence opt2 from neuraminidase__InfluenzaA__ACI32769
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaucuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108049 - RNA, 1413 nt, Artificial Sequence; identical to SEQ ID NO: 105898
  derived and/or modified sequence opt2 from neuraminidase__InfluenzaA__ACI32770

SEQ ID NO: 108050 - RNA, 1413 nt, Artificial Sequence
  derived and/or modified sequence opt2 from neuraminidase__InfluenzaA__ACI32771
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacaagaacuccaccugggucaaccacaccuacgucaacaucaacaacaccaacgucgucgccggcaagggcaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108051 - RNA, 1413 nt, Artificial Sequence; identical to SEQ ID NO: 105898
  derived and/or modified sequence opt2 from neuraminidase__InfluenzaA__ACI32772

SEQ ID NO: 108052 - RNA, 1413 nt, Artificial Sequence; identical to SEQ ID NO: 105898
  derived and/or modified sequence opt2 from neuraminidase__InfluenzaA__ACI32773

SEQ ID NO: 108053 - RNA, 1413 nt, Artificial Sequence; identical to SEQ ID NO: 105898
  derived and/or modified sequence opt2 from neuraminidase__InfluenzaA__ACI32774

SEQ ID NO: 108054 - RNA, 1413 nt, Artificial Sequence; identical to SEQ ID NO: 105898
  derived and/or modified sequence opt2 from neuraminidase__InfluenzaA__ACI32775

SEQ ID NO: 108055 - RNA, 1413 nt, Artificial Sequence
  derived and/or modified sequence opt2 from neuraminidase__InfluenzaA__ACI32776
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacaagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108056 - RNA, 1413 nt, Artificial Sequence
  derived and/or modified sequence opt2 from neuraminidase__InfluenzaA__ACI32777
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacaagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucgccaucgacaaguga

SEQ ID NO: 108057 - RNA, 1413 nt, Artificial Sequence; identical to SEQ ID NO: 105898
  derived and/or modified sequence opt2 from neuraminidase__InfluenzaA__ACI32778

SEQ ID NO: 108058 - RNA, 1413 nt, Artificial Sequence; identical to SEQ ID NO: 105898
  derived and/or modified sequence opt2 from neuraminidase__InfluenzaA__ACI32779

SEQ ID NO: 108059 - RNA, 1413 nt, Artificial Sequence; identical to SEQ ID NO: 105898
  derived and/or modified sequence opt2 from neuraminidase__InfluenzaA__ACI32780

SEQ ID NO: 108060 - RNA, 1413 nt, Artificial Sequence; identical to SEQ ID NO: 105898
  derived and/or modified sequence opt2 from neuraminidase__InfluenzaA__ACI32781

SEQ ID NO: 108061 - RNA, 1413 nt, Artificial Sequence
  derived and/or modified sequence opt2 from neuraminidase__InfluenzaA__ACI32782
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggccaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108062 - RNA, 1413 nt, Artificial Sequence
  derived and/or modified sequence opt2 from neuraminidase__InfluenzaA__ACI32783
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccuggcucuccuucaaccagaaccucgacuaccagaucggcuacaucugcuccggcgucaucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacggcgacaccgccaacugguccuggcccgacggcgccgagcuccccuucaccaucgacaaguga

SEQ ID NO: 108063 - RNA, 1413 nt, Artificial Sequence
  derived and/or modified sequence opt2 from neuraminidase__InfluenzaA__ACI32784
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggccaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108064 - RNA, 1413 nt, Artificial Sequence
  derived and/or modified sequence opt2 from neuraminidase__InfluenzaA__ACI32785
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaugugcaaccagcgcaucaucaccuacgagaacuccaccugggucaaccacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcugggccgacaccgacuccgacuucuccgucaagcaggacgucgucgccaucaccgacugguccggcuacuccggcuccuucguccagcaccccgagcucaccggccucaacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108065 - RNA, 1413 nt, Artificial Sequence
  derived and/or modified sequence opt2 from neuraminidase__InfluenzaA__ACI32787
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcggcaccgccgacugguccuggcccgacggcgccgagcuccccuucaccaucgacaaguga

SEQ ID NO: 108066 - RNA, 1413 nt, Artificial Sequence
  derived and/or modified sequence opt2 from neuraminidase__InfluenzaA__ACI32788
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaccugcaaccagcgcaucaucaccuacgagaacaacaccugggucaaccacaccugcgucaacaucaacaacaccaacgucgucgccggcaaggacaagaccuccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaagggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccaugaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108067 - RNA, 1410 nt, Artificial Sequence
  derived and/or modified sequence opt2 from neuraminidase__InfluenzaA__ACI32790
augaaccccaaccagaagaucaucaccaucggcuccgucucccucaccaucgccaccaucugcuuccucacccagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108068 - RNA, 1410 nt, Artificial Sequence; identical to SEQ ID NO: 105894
  derived and/or modified sequence opt2 from neuraminidase__InfluenzaA__ACI32791

SEQ ID NO: 108069 - RNA, 1410 nt, Artificial Sequence; identical to SEQ ID NO: 105894
  derived and/or modified sequence opt2 from neuraminidase__InfluenzaA__ACI32793

SEQ ID NO: 108070 - RNA, 1410 nt, Artificial Sequence; identical to SEQ ID NO: 105894
  derived and/or modified sequence opt2 from neuraminidase__InfluenzaA__ACI32794

SEQ ID NO: 108071 - RNA, 1410 nt, Artificial Sequence; identical to SEQ ID NO: 106224
  derived and/or modified sequence opt2 from neuraminidase__InfluenzaA__ACI32795

SEQ ID NO: 108072 - RNA, 1410 nt, Artificial Sequence
  derived and/or modified sequence opt2 from neuraminidase__InfluenzaA__ACI32796
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108073 - RNA, 1410 nt, Artificial Sequence
  derived and/or modified sequence opt2 from neuraminidase__InfluenzaA__ACI32797
augaaccccaaccagaugaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcuccaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108074 - RNA, 1410 nt, Artificial Sequence
  derived and/or modified sequence opt2 from neuraminidase__InfluenzaA__ACI32798
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaacgagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108075 - RNA, 1410 nt, Artificial Sequence
  derived and/or modified sequence opt2 from neuraminidase__InfluenzaA__ACI32799
augaaccccaaccagcgcaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccaacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108076 - RNA, 1410 nt, Artificial Sequence
  derived and/or modified sequence opt2 from neuraminidase__InfluenzaA__ACI32800
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108077 - RNA, 1410 nt, Artificial Sequence; identical to SEQ ID NO: 108076
  derived and/or modified sequence opt2 from neuraminidase__InfluenzaA__ACI32802

SEQ ID NO: 108078 - RNA, 1410 nt, Artificial Sequence; identical to SEQ ID NO: 108076
  derived and/or modified sequence opt2 from neuraminidase__InfluenzaA__ACI32803

SEQ ID NO: 108079 - RNA, 1410 nt, Artificial Sequence; identical to SEQ ID NO: 107219
  derived and/or modified sequence opt2 from neuraminidase__InfluenzaA__ACI32804

SEQ ID NO: 108080 - RNA, 1410 nt, Artificial Sequence
  derived and/or modified sequence opt2 from neuraminidase__InfluenzaA__ACI32805
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgucaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgaccgcuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108081 - RNA, 1410 nt, Artificial Sequence; identical to SEQ ID NO: 106224
  derived and/or modified sequence opt2 from neuraminidase__InfluenzaA__ACI32806

SEQ ID NO: 108082 - RNA, 1410 nt, Artificial Sequence
  derived and/or modified sequence opt2 from neuraminidase__InfluenzaA__ACI32807
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108083 - RNA, 1410 nt, Artificial Sequence
  derived and/or modified sequence opt2 from neuraminidase__InfluenzaA__ACI32808
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggagaagaccgagguccucuggaccuccaacuccaucgucgucuucugcggcaccuccggcaccuacggcaccggcuccuggcccgacggcgccgacaucaaccucaugcccaucuga

SEQ ID NO: 108084 - RNA, 1410 nt, Artificial Sequence; identical to SEQ ID NO: 107219
  derived and/or modified sequence opt2 from neuraminidase__InfluenzaA__ACI32809

SEQ ID NO: 108085 - RNA, 1410 nt, Artificial Sequence
  derived and/or modified sequence opt2 from neuraminidase__InfluenzaA__ACI32810
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcaccccccaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108086 - RNA, 1410 nt, Artificial Sequence
  derived and/or modified sequence opt2 from neuraminidase__InfluenzaA__ACI32811
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108087 - RNA, 1410 nt, Artificial Sequence
  derived and/or modified sequence opt2 from neuraminidase__InfluenzaA__ACI32812
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccaacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108088 - RNA, 1410 nt, Artificial Sequence; identical to SEQ ID NO: 106311
  derived and/or modified sequence opt2 from neuraminidase__InfluenzaA__ACI32814

SEQ ID NO: 108089 - RNA, 1350 nt, Artificial Sequence
  derived and/or modified sequence opt2 from neuraminidase__InfluenzaA__ACJ53848
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108090 - RNA, 1350 nt, Artificial Sequence
  derived and/or modified sequence opt2 from neuraminidase__InfluenzaA__ACJ53849
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcucccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108091 - RNA, 1350 nt, Artificial Sequence
  derived and/or modified sequence opt2 from neuraminidase__InfluenzaA__ACJ53853
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108092 - RNA, 1350 nt, Artificial Sequence; identical to SEQ ID NO: 108091
  derived and/or modified sequence opt2 from neuraminidase__InfluenzaA__ACJ53866

SEQ ID NO: 108093 - RNA, 1350 nt, Artificial Sequence
  derived and/or modified sequence opt2 from neuraminidase__InfluenzaA__ACJ53867
augaaccccaaccagaagaucaucaccaucggcuccaucugcauggccaucggcaucgucucccucaugcuccagaucggcaacaugaucucccucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108094 - RNA, 1350 nt, Artificial Sequence
  derived and/or modified sequence opt2 from neuraminidase__InfluenzaA__ACJ53875
augaaccccaaccagaagaucaucaccaucggcuccaucugcauggucaucggcaucgucucccucaugcuccagaucggcaacaugaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgaggcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108095 - RNA, 1350 nt, Artificial Sequence
  derived and/or modified sequence opt2 from neuraminidase__InfluenzaA__ACJ53876
augaaccccaaccagaagaucaucaccaucggcuccaucugcauggucaucggcaucgucucccucaugcuccagaucggcaacaucaucuccaucugggucucccacuccauccagaccggcaaccagugccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 108096 - RNA, 1404 nt, Artificial Sequence
  derived and/or modified sequence opt2 from neuraminidase__InfluenzaA__ACJ67535
augaaccccaaccagaagaucaucgcccucggcuccgucuccaucaccaucgccaccaucugccucaucaugcagaucgccguccucgccaccaccaugacccuccacuucaacgagugcaccaaccccuccaacaaccaggccaugcccugcgagcccaucaucaucgagcgcaacaugaccgagaucguccaccucaacaacaccaccaucgagaaggaguccugccccaaggucgccgaguacaagaacugguccaagccccagugccagaucaccggcuucgcccccuucuccaaggacaacuccauccgccucuccgccggcggcgacaucugggucacccgcgagcccuacgucuccugcggccucggcaacugcuaccaguucgcccucggccagggcaccacccucaacaacaagcacuccaacgacaccauccacgaccgcuccccccaccgcacccuccucaugaacgagcucggcguccccuuccaccucggcaccaagcaggucugcaucgccugguccuccuccuccugccacgacggcaaggccuggcuccacgucugcgucaccggcgacgaccgcaacgccaccgccuccaucaucuacgacggcaugcucaccgacuccaucggcuccugguccaagaacauccuccgcacccaggaguccgagugcgucugcaucaacggcaccugcaccgucgucaugaccgacggcuccgccuccggccgcgccgacaccaagauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuacaucaacgucgccgacuacuccgucgacuccuccuacgucugcuccggccucgucggcgacaccccccgcaacgacgacuccuccuccuccuccaacugccgcgaccccaacaacgagcgcggcggccccggcgucaagggcugggccuucgacaacggcaacgacgucuggaugggccgcaccaucaagaaggacucccgcuccggcuacgagaccuuccgcgucgucggcggcuggaccaccgccaacuccaagucccagaucaaccgccaggucaucgucgacuccgacaacugguccggcuacuccggcaucuucuccgucgagggcaagaccugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucauguccaucuga

SEQ ID NO: 108097 - RNA, 1410 nt, Artificial Sequence
  derived and/or modified sequence opt2 from neuraminidase__InfluenzaA__ACK99424
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucauccccugccagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaaggucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 108098 - RNA, 1410 nt, Artificial Sequence; identical to SEQ ID NO: 107917
  derived and/or modified sequence opt2 from neuraminidase__InfluenzaA__ACK99435

SEQ ID NO: 108099 - RNA, 1413 nt, Artificial Sequence
  derived and/or modified sequence opt2 from neuraminidase__InfluenzaA__ACK99446
augaaccccaaccagaagaucaucaccaucggcuccaucuccauggccaucggcaucaucucccucacccuccagaucggcaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcgcccucauguccugcccccucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggcaaggucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuaccgcuacggcaacggcgucuggaucggccgcaccaaguccaaccgcuuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108100 - RNA, 1410 nt, Artificial Sequence
  derived and/or modified sequence opt2 from neuraminidase__InfluenzaA__ACK99457
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 108101 - RNA, 1413 nt, Artificial Sequence
  derived and/or modified sequence opt2 from neuraminidase__InfluenzaA__ACK99468
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccaugacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacuccuccugcuucaccaucaugaccgacggccccuccaacggcgccgccuccuaccgcaucuucaagaucgagaagggccgcgucaccaaguccaucgagcucgacgcccccaacuaccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccaugaagcaggacaucgucgccaugaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108102 - RNA, 1410 nt, Artificial Sequence
  derived and/or modified sequence opt2 from neuraminidase__InfluenzaA__ACK99479
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccaacaucaaccucaugcccaucuga

SEQ ID NO: 108103 - RNA, 1413 nt, Artificial Sequence; identical to SEQ ID NO: 107796
  derived and/or modified sequence opt2 from neuraminidase__InfluenzaA__ACL12066

SEQ ID NO: 108104 - RNA, 1410 nt, Artificial Sequence; identical to SEQ ID NO: 106697
  derived and/or modified sequence opt2 from neuraminidase__InfluenzaA__ACL12132

SEQ ID NO: 108105 - RNA, 1413 nt, Artificial Sequence; identical to SEQ ID NO: 108030
  derived and/or modified sequence opt2 from neuraminidase__InfluenzaA__ACL12154

SEQ ID NO: 108106 - RNA, 1410 nt, Artificial Sequence; identical to SEQ ID NO: 108024
  derived and/or modified sequence opt2 from neuraminidase__InfluenzaA__ACL12165

SEQ ID NO: 108107 - RNA, 1410 nt, Artificial Sequence; identical to SEQ ID NO: 108024
  derived and/or modified sequence opt2 from neuraminidase__InfluenzaA__ACL12176

SEQ ID NO: 108108 - RNA, 1410 nt, Artificial Sequence
  derived and/or modified sequence opt2 from neuraminidase__InfluenzaA__ACL12198
augaaccccaaccagaagaucaucaccaucggcuccgucucccucaccaucuccaccaucugcuucuucaugcagaucgccauccucaucaccaccgucacccuccacuucaagcaguacgaguucaacuccacccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108109 - RNA, 1410 nt, Artificial Sequence; identical to SEQ ID NO: 107602
  derived and/or modified sequence opt2 from neuraminidase__InfluenzaA__ACL12209

SEQ ID NO: 108110 - RNA, 1410 nt, Artificial Sequence; identical to SEQ ID NO: 108024
  derived and/or modified sequence opt2 from neuraminidase__InfluenzaA__ACL12220

SEQ ID NO: 108111 - RNA, 1410 nt, Artificial Sequence
  derived and/or modified sequence opt2 from neuraminidase__InfluenzaA__ACL12242
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108112 - RNA, 1413 nt, Artificial Sequence
  derived and/or modified sequence opt2 from neuraminidase__InfluenzaA__ACL12264
augaaccccaaccagaagaucaucaccaucggcuccaucuccauggccaucggcaucaucucccucauccuccagaucgucaacaucaucuccaucugggucucccacuccauccagaccggcucccagaaccacaccggcaucugcaaccagcgcaucaucaccuacgagaacuccaccugggucaaccagaccuacgucaacaucaacaacaccaacgucgucgccggcaaggacaagaccuccgucacccucgccggcaacuccucccucugccccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuaccgcaucuucaagaucgagaagggcaaggucaccaaguccaucgagcucgacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcgaccccgucaccgucgacggcgccgacggcgucaagggcuucuccuaccgcuacggcaacggcgucuggaucggccgcaccaaguccaaccgcuuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcaugcgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108113 - RNA, 1410 nt, Artificial Sequence; identical to SEQ ID NO: 107917
  derived and/or modified sequence opt2 from neuraminidase__InfluenzaA__ACN32275

SEQ ID NO: 108114 - RNA, 1410 nt, Artificial Sequence
  derived and/or modified sequence opt2 from neuraminidase__InfluenzaA__ACN32286
augaaccccaacaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccuccucggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108115 - RNA, 1410 nt, Artificial Sequence
  derived and/or modified sequence opt2 from neuraminidase__InfluenzaA__ACN32493
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108116 - RNA, 1410 nt, Artificial Sequence; identical to SEQ ID NO: 105666
  derived and/or modified sequence opt2 from neuraminidase__InfluenzaA__ACN32526

SEQ ID NO: 108117 - RNA, 1410 nt, Artificial Sequence
  derived and/or modified sequence opt2 from neuraminidase__InfluenzaA__ACN32537
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccgacguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgacggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 108118 - RNA, 1413 nt, Artificial Sequence; identical to SEQ ID NO: 107594
  derived and/or modified sequence opt2 from neuraminidase__InfluenzaA__ACN32807

SEQ ID NO: 108119 - RNA, 1413 nt, Artificial Sequence; identical to SEQ ID NO: 107542
  derived and/or modified sequence opt2 from neuraminidase__InfluenzaA__ACN32818

SEQ ID NO: 108120 - RNA, 1413 nt, Artificial Sequence; identical to SEQ ID NO: 107542
  derived and/or modified sequence opt2 from neuraminidase__InfluenzaA__ACN32829

SEQ ID NO: 108121 - RNA, 1413 nt, Artificial Sequence
  derived and/or modified sequence opt2 from neuraminidase__InfluenzaA__ACN32840
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgucaacugguccuggcccgacggcgccgagcuccccuucaccaucgacaaguga

SEQ ID NO: 108122 - RNA, 1410 nt, Artificial Sequence; identical to SEQ ID NO: 108024
  derived and/or modified sequence opt2 from neuraminidase__InfluenzaA__ACN32851

SEQ ID NO: 108123 - RNA, 1410 nt, Artificial Sequence; identical to SEQ ID NO: 108111
  derived and/or modified sequence opt2 from neuraminidase__InfluenzaA__ACN32862

SEQ ID NO: 108124 - RNA, 1410 nt, Artificial Sequence; identical to SEQ ID NO: 108115
  derived and/or modified sequence opt2 from neuraminidase__InfluenzaA__ACN32873

SEQ ID NO: 108125 - RNA, 1410 nt, Artificial Sequence; identical to SEQ ID NO: 108111
  derived and/or modified sequence opt2 from neuraminidase__InfluenzaA__ACN32884

SEQ ID NO: 108126 - RNA, 1410 nt, Artificial Sequence; identical to SEQ ID NO: 108115
  derived and/or modified sequence opt2 from neuraminidase__InfluenzaA__ACN32895

SEQ ID NO: 108127 - RNA, 1410 nt, Artificial Sequence; identical to SEQ ID NO: 108024
  derived and/or modified sequence opt2 from neuraminidase__InfluenzaA__ACN32906

SEQ ID NO: 108128 - RNA, 1410 nt, Artificial Sequence
  derived and/or modified sequence opt2 from neuraminidase__InfluenzaA__ACN32917
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcaagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaccgaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108129 - RNA, 1410 nt, Artificial Sequence
  derived and/or modified sequence opt2 from neuraminidase__InfluenzaA__ACN32928
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaccgaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108130 - RNA, 1410 nt, Artificial Sequence; identical to SEQ ID NO: 108115
  derived and/or modified sequence opt2 from neuraminidase__InfluenzaA__ACN32939

SEQ ID NO: 108131 - RNA, 1410 nt, Artificial Sequence; identical to SEQ ID NO: 108024
  derived and/or modified sequence opt2 from neuraminidase__InfluenzaA__ACN32950

SEQ ID NO: 108132 - RNA, 1410 nt, Artificial Sequence
  derived and/or modified sequence opt2 from neuraminidase__InfluenzaA__ACN32961
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaccgaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaacaucaugcccaucuga

SEQ ID NO: 108133 - RNA, 1410 nt, Artificial Sequence; identical to SEQ ID NO: 108111
  derived and/or modified sequence opt2 from neuraminidase__InfluenzaA__ACN32972

SEQ ID NO: 108134 - RNA, 1410 nt, Artificial Sequence; identical to SEQ ID NO: 108111
  derived and/or modified sequence opt2 from neuraminidase__InfluenzaA__ACN32994

SEQ ID NO: 108135 - RNA, 1410 nt, Artificial Sequence
  derived and/or modified sequence opt2 from neuraminidase__InfluenzaA__ACN33005
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcgaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108136 - RNA, 1410 nt, Artificial Sequence; identical to SEQ ID NO: 108111
  derived and/or modified sequence opt2 from neuraminidase__InfluenzaA__ACN33016

SEQ ID NO: 108137 - RNA, 1410 nt, Artificial Sequence; identical to SEQ ID NO: 108111
  derived and/or modified sequence opt2 from neuraminidase__InfluenzaA__ACN33049

SEQ ID NO: 108138 - RNA, 1410 nt, Artificial Sequence; identical to SEQ ID NO: 108111
  derived and/or modified sequence opt2 from neuraminidase__InfluenzaA__ACN33060

SEQ ID NO: 108139 - RNA, 1410 nt, Artificial Sequence; identical to SEQ ID NO: 108115
  derived and/or modified sequence opt2 from neuraminidase__InfluenzaA__ACN33082

SEQ ID NO: 108140 - RNA, 1413 nt, Artificial Sequence; identical to SEQ ID NO: 107581
  derived and/or modified sequence opt2 from neuraminidase__InfluenzaA__ACN33093

SEQ ID NO: 108141 - RNA, 1413 nt, Artificial Sequence; identical to SEQ ID NO: 107542
  derived and/or modified sequence opt2 from neuraminidase__InfluenzaA__ACN33104

SEQ ID NO: 108142 - RNA, 1410 nt, Artificial Sequence; identical to SEQ ID NO: 108115
  derived and/or modified sequence opt2 from neuraminidase__InfluenzaA__ACN33115

SEQ ID NO: 108143 - RNA, 1413 nt, Artificial Sequence
  derived and/or modified sequence opt2 from neuraminidase__InfluenzaA__ACN33126
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcuccuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108144 - RNA, 1413 nt, Artificial Sequence
  derived and/or modified sequence opt2 from neuraminidase__InfluenzaA__ACN33148
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108145 - RNA, 1410 nt, Artificial Sequence
  derived and/or modified sequence opt2 from neuraminidase__InfluenzaA__ACN33159
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108146 - RNA, 1410 nt, Artificial Sequence; identical to SEQ ID NO: 108024
  derived and/or modified sequence opt2 from neuraminidase__InfluenzaA__ACN33170

SEQ ID NO: 108147 - RNA, 1410 nt, Artificial Sequence; identical to SEQ ID NO: 108115
  derived and/or modified sequence opt2 from neuraminidase__InfluenzaA__ACN33181

SEQ ID NO: 108148 - RNA, 1410 nt, Artificial Sequence; identical to SEQ ID NO: 108115
  derived and/or modified sequence opt2 from neuraminidase__InfluenzaA__ACN33203

SEQ ID NO: 108149 - RNA, 1410 nt, Artificial Sequence
  derived and/or modified sequence opt2 from neuraminidase__InfluenzaA__ACN33214
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaccgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108150 - RNA, 1413 nt, Artificial Sequence; identical to SEQ ID NO: 107583
  derived and/or modified sequence opt2 from neuraminidase__InfluenzaA__ACN42984

SEQ ID NO: 108151 - RNA, 1413 nt, Artificial Sequence; identical to SEQ ID NO: 107583
  derived and/or modified sequence opt2 from neuraminidase__InfluenzaA__ACN42995

SEQ ID NO: 108152 - RNA, 1410 nt, Artificial Sequence
  derived and/or modified sequence opt2 from neuraminidase__InfluenzaA__ACN43006
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccgcgucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108153 - RNA, 1410 nt, Artificial Sequence; identical to SEQ ID NO: 108115
  derived and/or modified sequence opt2 from neuraminidase__InfluenzaA__ACN43017

SEQ ID NO: 108154 - RNA, 1410 nt, Artificial Sequence; identical to SEQ ID NO: 108111
  derived and/or modified sequence opt2 from neuraminidase__InfluenzaA__ACN43028

SEQ ID NO: 108155 - RNA, 1410 nt, Artificial Sequence
  derived and/or modified sequence opt2 from neuraminidase__InfluenzaA__ACN43039
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucgagaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108156 - RNA, 1410 nt, Artificial Sequence; identical to SEQ ID NO: 108024
  derived and/or modified sequence opt2 from neuraminidase__InfluenzaA__ACN43050

SEQ ID NO: 108157 - RNA, 1410 nt, Artificial Sequence; identical to SEQ ID NO: 108111
  derived and/or modified sequence opt2 from neuraminidase__InfluenzaA__ACN43061

SEQ ID NO: 108158 - RNA, 1410 nt, Artificial Sequence
  derived and/or modified sequence opt2 from neuraminidase__InfluenzaA__ACN43072
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccgucgucgucuucugcggcaccuccggcaccuacggcaccggcuccuggcccgacggcgccgacaucaaccucaugcccaucuga

SEQ ID NO: 108159 - RNA, 1410 nt, Artificial Sequence
  derived and/or modified sequence opt2 from neuraminidase__InfluenzaA__ACN43083
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaacgagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108160 - RNA, 1410 nt, Artificial Sequence; identical to SEQ ID NO: 105839
  derived and/or modified sequence opt2 from neuraminidase__InfluenzaA__ACN50231

SEQ ID NO: 108161 - RNA, 1410 nt, Artificial Sequence
  derived and/or modified sequence opt2 from neuraminidase__InfluenzaA__ACN50233
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucguccucaccgacggcuccgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108162 - RNA, 1410 nt, Artificial Sequence
  derived and/or modified sequence opt2 from neuraminidase__InfluenzaA__ACN50245
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucguccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108163 - RNA, 1413 nt, Artificial Sequence
  derived and/or modified sequence opt2 from neuraminidase__InfluenzaA__ACN72609
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuacaagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108164 - RNA, 1410 nt, Artificial Sequence
  derived and/or modified sequence opt2 from neuraminidase__InfluenzaA__ACN72621
augaaccccaaccagaagaucaucaucaucuccuccaucugcaugaccaacggcaucgccucccucauccuccagaucggcaacaucaucuccaucuggaucucccacuccauccagaccggcaaccagaaccagaccgagaccugcaaccaguccgucaucaucuacgagaacaacaccugggucaaccagaccuacgucaacaucuccaacaacaacuucgucgccgagcagaccgucguccccgucaagcucgucggcuccuccccccucugccccgucuccggcugggccaucuacuccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcacccucauguccugccccaucggcgagguccccucccccuacaacucccgcuucgaguccgucgccugguccgccuccgccugccacgacggcuccuccuggcucaccaucggcaucuccggccccgacaacggcgccgucgccguccucaaguacaacgacaucaucaccgacaccaucaaguccuggaagaacaacauccuccgcacccaggaguccgagugcgccugccucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacuccggcgagaucaucugcgucugccgcgacaacuggcacggcuccaaccgccccugggucuccuucaaccagaaccucgaguaccagaucggcuacaucugcuccggcguccucggcgacaacccccgccccaacgaccgcaccggcaacugcggccccgucuccucccacggcgccaacggcgucaagggcuucuccuucaaguacggcgacggcaucuggaucggccgcaccaaguccaccuccucccgcuccggcuucgagaugaucugggaccccaacggcuggaccggcaccgacaacaacuucuccgucaagcaggacaucgucggcaucaccgacuggaccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108165 - RNA, 1410 nt, Artificial Sequence; identical to SEQ ID NO: 108024
  derived and/or modified sequence opt2 from neuraminidase__InfluenzaA__ACN76503

SEQ ID NO: 108166 - RNA, 1410 nt, Artificial Sequence
  derived and/or modified sequence opt2 from neuraminidase__InfluenzaA__ACO36345
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcagugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108167 - RNA, 1410 nt, Artificial Sequence; identical to SEQ ID NO: 106492
  derived and/or modified sequence opt2 from neuraminidase__InfluenzaA__ACO36356

SEQ ID NO: 108168 - RNA, 1410 nt, Artificial Sequence
  derived and/or modified sequence opt2 from neuraminidase__InfluenzaA__ACO36367
augaaccccaaccagaagaucaucaccaucggcuccgucucccucaucaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuucggcaccggcuccuggcccgacggcgccgacaucaaccucaugcccaucuga

SEQ ID NO: 108169 - RNA, 1413 nt, Artificial Sequence; identical to SEQ ID NO: 108144
  derived and/or modified sequence opt2 from neuraminidase__InfluenzaA__ACO36400

SEQ ID NO: 108170 - RNA, 1410 nt, Artificial Sequence
  derived and/or modified sequence opt2 from neuraminidase__InfluenzaA__ACO36411
augaaccccaaccagaagaucaucaccaucggcuccgucucccucaccaucuccaccaucggcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108171 - RNA, 1410 nt, Artificial Sequence
  derived and/or modified sequence opt2 from neuraminidase__InfluenzaA__ACO36422
augaaccccaaccagaagaucaucaccaucggcuccgucucccucaucaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108172 - RNA, 1410 nt, Artificial Sequence; identical to SEQ ID NO: 107928
  derived and/or modified sequence opt2 from neuraminidase__InfluenzaA__ACO36433

SEQ ID NO: 108173 - RNA, 1410 nt, Artificial Sequence
  derived and/or modified sequence opt2 from neuraminidase__InfluenzaA__ACO36444
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccgagaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 108174 - RNA, 1410 nt, Artificial Sequence
  derived and/or modified sequence opt2 from neuraminidase__InfluenzaA__ACO36466
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgccuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108175 - RNA, 1410 nt, Artificial Sequence
  derived and/or modified sequence opt2 from neuraminidase__InfluenzaA__ACO36477
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 108176 - RNA, 1410 nt, Artificial Sequence
  derived and/or modified sequence opt2 from neuraminidase__InfluenzaA__ACO36499
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108177 - RNA, 1410 nt, Artificial Sequence; identical to SEQ ID NO: 105839
  derived and/or modified sequence opt2 from neuraminidase__InfluenzaA__ACO36510

SEQ ID NO: 108178 - RNA, 1410 nt, Artificial Sequence; identical to SEQ ID NO: 105839
  derived and/or modified sequence opt2 from neuraminidase__InfluenzaA__ACO36543

SEQ ID NO: 108179 - RNA, 1410 nt, Artificial Sequence; identical to SEQ ID NO: 105839
  derived and/or modified sequence opt2 from neuraminidase__InfluenzaA__ACO36554

SEQ ID NO: 108180 - RNA, 1410 nt, Artificial Sequence; identical to SEQ ID NO: 105839
  derived and/or modified sequence opt2 from neuraminidase__InfluenzaA__ACO36565

SEQ ID NO: 108181 - RNA, 1410 nt, Artificial Sequence
  derived and/or modified sequence opt2 from neuraminidase__InfluenzaA__ACO36576
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucggccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108182 - RNA, 1410 nt, Artificial Sequence; identical to SEQ ID NO: 105839
  derived and/or modified sequence opt2 from neuraminidase__InfluenzaA__ACO36587

SEQ ID NO: 108183 - RNA, 1410 nt, Artificial Sequence; identical to SEQ ID NO: 106224
  derived and/or modified sequence opt2 from neuraminidase__InfluenzaA__ACO36609

SEQ ID NO: 108184 - RNA, 1410 nt, Artificial Sequence
  derived and/or modified sequence opt2 from neuraminidase__InfluenzaA__ACO36620
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccaggucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108185 - RNA, 1410 nt, Artificial Sequence; identical to SEQ ID NO: 106224
  derived and/or modified sequence opt2 from neuraminidase__InfluenzaA__ACO36631

SEQ ID NO: 108186 - RNA, 1410 nt, Artificial Sequence; identical to SEQ ID NO: 106224
  derived and/or modified sequence opt2 from neuraminidase__InfluenzaA__ACO36653

SEQ ID NO: 108187 - RNA, 1410 nt, Artificial Sequence
  derived and/or modified sequence opt2 from neuraminidase__InfluenzaA__ACO36675
augaaccccaaccagaagaucaucaccaucggcuccgucucccucaccaucuccaccaucugccucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108188 - RNA, 1410 nt, Artificial Sequence
  derived and/or modified sequence opt2 from neuraminidase__InfluenzaA__ACO36686
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccacgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108189 - RNA, 1410 nt, Artificial Sequence
  derived and/or modified sequence opt2 from neuraminidase__InfluenzaA__ACO37125
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggcaugcucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108190 - RNA, 1410 nt, Artificial Sequence
  derived and/or modified sequence opt2 from neuraminidase__InfluenzaA__ACO94511
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccuccaacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108191 - RNA, 1410 nt, Artificial Sequence; identical to SEQ ID NO: 108024
  derived and/or modified sequence opt2 from neuraminidase__InfluenzaA__ACO94512

SEQ ID NO: 108192 - RNA, 1410 nt, Artificial Sequence; identical to SEQ ID NO: 108111
  derived and/or modified sequence opt2 from neuraminidase__InfluenzaA__ACO94513

SEQ ID NO: 108193 - RNA, 1410 nt, Artificial Sequence
  derived and/or modified sequence opt2 from neuraminidase__InfluenzaA__ACO94675
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108194 - RNA, 1410 nt, Artificial Sequence
  derived and/or modified sequence opt2 from neuraminidase__InfluenzaA__ACO94686
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaccaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgagaucaaccucaugcccaucuga

SEQ ID NO: 108195 - RNA, 1410 nt, Artificial Sequence; identical to SEQ ID NO: 108111
  derived and/or modified sequence opt2 from neuraminidase__InfluenzaA__ACO94697

SEQ ID NO: 108196 - RNA, 1413 nt, Artificial Sequence; identical to SEQ ID NO: 108144
  derived and/or modified sequence opt2 from neuraminidase__InfluenzaA__ACO94708

SEQ ID NO: 108197 - RNA, 1410 nt, Artificial Sequence
  derived and/or modified sequence opt2 from neuraminidase__InfluenzaA__ACO94719
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgagaucaaccucaugcccaucuga

SEQ ID NO: 108198 - RNA, 1410 nt, Artificial Sequence
  derived and/or modified sequence opt2 from neuraminidase__InfluenzaA__ACO94741
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgaguccaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108199 - RNA, 1410 nt, Artificial Sequence; identical to SEQ ID NO: 108115
  derived and/or modified sequence opt2 from neuraminidase__InfluenzaA__ACO94763

SEQ ID NO: 108200 - RNA, 1410 nt, Artificial Sequence
  derived and/or modified sequence opt2 from neuraminidase__InfluenzaA__ACO94774
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggccgcgccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108201 - RNA, 1410 nt, Artificial Sequence
  derived and/or modified sequence opt2 from neuraminidase__InfluenzaA__ACO94785
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcaagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108202 - RNA, 1410 nt, Artificial Sequence; identical to SEQ ID NO: 108111
  derived and/or modified sequence opt2 from neuraminidase__InfluenzaA__ACO94796

SEQ ID NO: 108203 - RNA, 1413 nt, Artificial Sequence
  derived and/or modified sequence opt2 from neuraminidase__InfluenzaA__ACO94807
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcaccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 108204 - RNA, 1410 nt, Artificial Sequence; identical to SEQ ID NO: 107926
  derived and/or modified sequence opt2 from neuraminidase__InfluenzaA__ACO94818

SEQ ID NO: 108205 - RNA, 1365 nt, Artificial Sequence; identical to SEQ ID NO: 107231
  derived and/or modified sequence opt2 from neuraminidase__InfluenzaA__ACO94829

SEQ ID NO: 108206 - RNA, 1365 nt, Artificial Sequence; identical to SEQ ID NO: 107231
  derived and/or modified sequence opt2 from neuraminidase__InfluenzaA__ACO94840

SEQ ID NO: 108207 - RNA, 1410 nt, Artificial Sequence
  derived and/or modified sequence opt2 from neuraminidase__InfluenzaA__ACO94851
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108208 - RNA, 1413 nt, Artificial Sequence; identical to SEQ ID NO: 108144
  derived and/or modified sequence opt2 from neuraminidase__InfluenzaA__ACO94873

SEQ ID NO: 108209 - RNA, 1410 nt, Artificial Sequence
  derived and/or modified sequence opt2 from neuraminidase__InfluenzaA__ACO94884
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 108210 - RNA, 1410 nt, Artificial Sequence; identical to SEQ ID NO: 106226
  derived and/or modified sequence opt2 from neuraminidase__InfluenzaA__ACO94906

SEQ ID NO: 108211 - RNA, 1410 nt, Artificial Sequence; identical to SEQ ID NO: 105657
  derived and/or modified sequence opt2 from neuraminidase__InfluenzaA__ACO94917

SEQ ID NO: 108212 - RNA, 1410 nt, Artificial Sequence; identical to SEQ ID NO: 106226
  derived and/or modified sequence opt2 from neuraminidase__InfluenzaA__ACO94928

SEQ ID NO: 108213 - RNA, 1410 nt, Artificial Sequence; identical to SEQ ID NO: 105657
  derived and/or modified sequence opt2 from neuraminidase__InfluenzaA__ACO94939

SEQ ID NO: 108214 - RNA, 1410 nt, Artificial Sequence
  derived and/or modified sequence opt2 from neuraminidase__InfluenzaA__ACO94950
augaaccccaaccagaagaucaucaccaucggcuccgucucccucaccaucuccaccaucugcuuccucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108215 - RNA, 1410 nt, Artificial Sequence
  derived and/or modified sequence opt2 from neuraminidase__InfluenzaA__ACO94961
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagcucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108216 - RNA, 1410 nt, Artificial Sequence
  derived and/or modified sequence opt2 from neuraminidase__InfluenzaA__ACO94972
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108217 - RNA, 1410 nt, Artificial Sequence
  derived and/or modified sequence opt2 from neuraminidase__InfluenzaA__ACO95156
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaccugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108218 - RNA, 1410 nt, Artificial Sequence; identical to SEQ ID NO: 105839
  derived and/or modified sequence opt2 from neuraminidase__InfluenzaA__ACO95174

SEQ ID NO: 108219 - RNA, 1410 nt, Artificial Sequence; identical to SEQ ID NO: 105839
  derived and/or modified sequence opt2 from neuraminidase__InfluenzaA__ACO95185

SEQ ID NO: 108220 - RNA, 1410 nt, Artificial Sequence
  derived and/or modified sequence opt2 from neuraminidase__InfluenzaA__ACO95196
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108221 - RNA, 1410 nt, Artificial Sequence; identical to SEQ ID NO: 105839
  derived and/or modified sequence opt2 from neuraminidase__InfluenzaA__ACO95207

SEQ ID NO: 108222 - RNA, 1410 nt, Artificial Sequence; identical to SEQ ID NO: 105839
  derived and/or modified sequence opt2 from neuraminidase__InfluenzaA__ACO95218

SEQ ID NO: 108223 - RNA, 1410 nt, Artificial Sequence; identical to SEQ ID NO: 105842
  derived and/or modified sequence opt2 from neuraminidase__InfluenzaA__ACO95229

SEQ ID NO: 108224 - RNA, 1410 nt, Artificial Sequence; identical to SEQ ID NO: 106224
  derived and/or modified sequence opt2 from neuraminidase__InfluenzaA__ACO95240

SEQ ID NO: 108225 - RNA, 1410 nt, Artificial Sequence; identical to SEQ ID NO: 106085
  derived and/or modified sequence opt2 from neuraminidase__InfluenzaA__ACO95262

SEQ ID NO: 108226 - RNA, 1410 nt, Artificial Sequence; identical to SEQ ID NO: 108023
  derived and/or modified sequence opt2 from neuraminidase__InfluenzaA__ACO95273

SEQ ID NO: 108227 - RNA, 1410 nt, Artificial Sequence; identical to SEQ ID NO: 108115
  derived and/or modified sequence opt2 from neuraminidase__InfluenzaA__ACO95306

SEQ ID NO: 108228 - RNA, 1413 nt, Artificial Sequence
  derived and/or modified sequence opt2 from neuraminidase__InfluenzaA__ACO95385
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccgacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108229 - RNA, 1413 nt, Artificial Sequence; identical to SEQ ID NO: 108144
  derived and/or modified sequence opt2 from neuraminidase__InfluenzaA__ACO95407

SEQ ID NO: 108230 - RNA, 1413 nt, Artificial Sequence; identical to SEQ ID NO: 108144
  derived and/or modified sequence opt2 from neuraminidase__InfluenzaA__ACO95418

SEQ ID NO: 108231 - RNA, 1410 nt, Artificial Sequence; identical to SEQ ID NO: 105657
  derived and/or modified sequence opt2 from neuraminidase__InfluenzaA__ACO95429

SEQ ID NO: 108232 - RNA, 1410 nt, Artificial Sequence; identical to SEQ ID NO: 106226
  derived and/or modified sequence opt2 from neuraminidase__InfluenzaA__ACO95440

SEQ ID NO: 108233 - RNA, 1410 nt, Artificial Sequence
  derived and/or modified sequence opt2 from neuraminidase__InfluenzaA__ACO95462
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcucaucuga

SEQ ID NO: 108234 - RNA, 1410 nt, Artificial Sequence; identical to SEQ ID NO: 106224
  derived and/or modified sequence opt2 from neuraminidase__InfluenzaA__ACO95484

SEQ ID NO: 108235 - RNA, 1410 nt, Artificial Sequence; identical to SEQ ID NO: 106224
  derived and/or modified sequence opt2 from neuraminidase__InfluenzaA__ACO95495

SEQ ID NO: 108236 - RNA, 1410 nt, Artificial Sequence; identical to SEQ ID NO: 106224
  derived and/or modified sequence opt2 from neuraminidase__InfluenzaA__ACO95506

SEQ ID NO: 108237 - RNA, 1410 nt, Artificial Sequence
  derived and/or modified sequence opt2 from neuraminidase__InfluenzaA__ACO95517
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108238 - RNA, 1410 nt, Artificial Sequence
  derived and/or modified sequence opt2 from neuraminidase__InfluenzaA__ACO95539
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccaacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108239 - RNA, 1413 nt, Artificial Sequence
  derived and/or modified sequence opt2 from neuraminidase__InfluenzaA__ACP20223
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccgucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108240 - RNA, 1410 nt, Artificial Sequence
  derived and/or modified sequence opt2 from neuraminidase__InfluenzaA__ACP41952
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108241 - RNA, 1410 nt, Artificial Sequence; identical to SEQ ID NO: 108240
  derived and/or modified sequence opt2 from neuraminidase__InfluenzaA__ACP44158

SEQ ID NO: 108242 - RNA, 1413 nt, Artificial Sequence
  derived and/or modified sequence opt2 from neuraminidase__InfluenzaA__ACP44195
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccgacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucaacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108243 - RNA, 1413 nt, Artificial Sequence; identical to SEQ ID NO: 108144
  derived and/or modified sequence opt2 from neuraminidase__InfluenzaA__ACP44217

SEQ ID NO: 108244 - RNA, 1413 nt, Artificial Sequence; identical to SEQ ID NO: 108144
  derived and/or modified sequence opt2 from neuraminidase__InfluenzaA__ACP44228

SEQ ID NO: 108245 - RNA, 1410 nt, Artificial Sequence; identical to SEQ ID NO: 106226
  derived and/or modified sequence opt2 from neuraminidase__InfluenzaA__ACP44239

SEQ ID NO: 108246 - RNA, 1410 nt, Artificial Sequence
  derived and/or modified sequence opt2 from neuraminidase__InfluenzaA__ACP44250
augaaccccaaccagaagaucaucaccaucggcuccgucucccucaccaucuccaccaucugcuucuucaugcagaucgccauccucaugaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108247 - RNA, 1410 nt, Artificial Sequence
  derived and/or modified sequence opt2 from neuraminidase__InfluenzaA__ACP44261
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacaugcacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108248 - RNA, 1410 nt, Artificial Sequence
  derived and/or modified sequence opt2 from neuraminidase__InfluenzaA__ACP44272
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucaucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108249 - RNA, 1410 nt, Artificial Sequence; identical to SEQ ID NO: 108240
  derived and/or modified sequence opt2 from neuraminidase__InfluenzaA__ACQ55360

SEQ ID NO: 108250 - RNA, 1410 nt, Artificial Sequence
  derived and/or modified sequence opt2 from neuraminidase__InfluenzaA__ACQ63236
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108251 - RNA, 1410 nt, Artificial Sequence; identical to SEQ ID NO: 108250
  derived and/or modified sequence opt2 from neuraminidase__InfluenzaA__ACQ63242

SEQ ID NO: 108252 - RNA, 1410 nt, Artificial Sequence; identical to SEQ ID NO: 108250
  derived and/or modified sequence opt2 from neuraminidase__InfluenzaA__ACQ63253

SEQ ID NO: 108253 - RNA, 1410 nt, Artificial Sequence; identical to SEQ ID NO: 108250
  derived and/or modified sequence opt2 from neuraminidase__InfluenzaA__ACQ63262

SEQ ID NO: 108254 - RNA, 1410 nt, Artificial Sequence
  derived and/or modified sequence opt2 from neuraminidase__InfluenzaA__ACQ65694
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaugaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108255 - RNA, 1410 nt, Artificial Sequence
  derived and/or modified sequence opt2 from neuraminidase__InfluenzaA__ACQ65705
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaugaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108256 - RNA, 1410 nt, Artificial Sequence; identical to SEQ ID NO: 108024
  derived and/or modified sequence opt2 from neuraminidase__InfluenzaA__ACQ65716

SEQ ID NO: 108257 - RNA, 1410 nt, Artificial Sequence; identical to SEQ ID NO: 108024
  derived and/or modified sequence opt2 from neuraminidase__InfluenzaA__ACQ65727

SEQ ID NO: 108258 - RNA, 1410 nt, Artificial Sequence; identical to SEQ ID NO: 108111
  derived and/or modified sequence opt2 from neuraminidase__InfluenzaA__ACQ65739

SEQ ID NO: 108259 - RNA, 1410 nt, Artificial Sequence
  derived and/or modified sequence opt2 from neuraminidase__InfluenzaA__ACQ65750
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108260 - RNA, 1413 nt, Artificial Sequence; identical to SEQ ID NO: 108144
  derived and/or modified sequence opt2 from neuraminidase__InfluenzaA__ACQ65761

SEQ ID NO: 108261 - RNA, 1410 nt, Artificial Sequence; identical to SEQ ID NO: 108240
  derived and/or modified sequence opt2 from neuraminidase__InfluenzaA__ACQ73394

SEQ ID NO: 108262 - RNA, 1410 nt, Artificial Sequence; identical to SEQ ID NO: 108240
  derived and/or modified sequence opt2 from neuraminidase__InfluenzaA__ACQ73395

SEQ ID NO: 108263 - RNA, 1410 nt, Artificial Sequence; identical to SEQ ID NO: 108250
  derived and/or modified sequence opt2 from neuraminidase__InfluenzaA__ACQ73396

SEQ ID NO: 108264 - RNA, 1410 nt, Artificial Sequence; identical to SEQ ID NO: 108250
  derived and/or modified sequence opt2 from neuraminidase__InfluenzaA__ACQ76291

SEQ ID NO: 108265 - RNA, 1410 nt, Artificial Sequence
  derived and/or modified sequence opt2 from neuraminidase__InfluenzaA__ACQ76298
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108266 - RNA, 1410 nt, Artificial Sequence; identical to SEQ ID NO: 108250
  derived and/or modified sequence opt2 from neuraminidase__InfluenzaA__ACQ76308

SEQ ID NO: 108267 - RNA, 1410 nt, Artificial Sequence; identical to SEQ ID NO: 108250
  derived and/or modified sequence opt2 from neuraminidase__InfluenzaA__ACQ76316

SEQ ID NO: 108268 - RNA, 1410 nt, Artificial Sequence; identical to SEQ ID NO: 108240
  derived and/or modified sequence opt2 from neuraminidase__InfluenzaA__ACQ76322

SEQ ID NO: 108269 - RNA, 1410 nt, Artificial Sequence; identical to SEQ ID NO: 108240
  derived and/or modified sequence opt2 from neuraminidase__InfluenzaA__ACQ76328

SEQ ID NO: 108270 - RNA, 1410 nt, Artificial Sequence; identical to SEQ ID NO: 108240
  derived and/or modified sequence opt2 from neuraminidase__InfluenzaA__ACQ76335

SEQ ID NO: 108271 - RNA, 1410 nt, Artificial Sequence; identical to SEQ ID NO: 108240
  derived and/or modified sequence opt2 from neuraminidase__InfluenzaA__ACQ76342

SEQ ID NO: 108272 - RNA, 1410 nt, Artificial Sequence; identical to SEQ ID NO: 108240
  derived and/or modified sequence opt2 from neuraminidase__InfluenzaA__ACQ76351

SEQ ID NO: 108273 - RNA, 1410 nt, Artificial Sequence; identical to SEQ ID NO: 108240
  derived and/or modified sequence opt2 from neuraminidase__InfluenzaA__ACQ76359

SEQ ID NO: 108274 - RNA, 1410 nt, Artificial Sequence; identical to SEQ ID NO: 108250
  derived and/or modified sequence opt2 from neuraminidase__InfluenzaA__ACQ76364

SEQ ID NO: 108275 - RNA, 1410 nt, Artificial Sequence; identical to SEQ ID NO: 108250
  derived and/or modified sequence opt2 from neuraminidase__InfluenzaA__ACQ76367

SEQ ID NO: 108276 - RNA, 1410 nt, Artificial Sequence
  derived and/or modified sequence opt2 from neuraminidase__InfluenzaA__ACQ76379
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacaagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108277 - RNA, 1410 nt, Artificial Sequence; identical to SEQ ID NO: 108250
  derived and/or modified sequence opt2 from neuraminidase__InfluenzaA__ACQ76385

SEQ ID NO: 108278 - RNA, 1410 nt, Artificial Sequence; identical to SEQ ID NO: 108250
  derived and/or modified sequence opt2 from neuraminidase__InfluenzaA__ACQ76388

SEQ ID NO: 108279 - RNA, 1410 nt, Artificial Sequence; identical to SEQ ID NO: 108250
  derived and/or modified sequence opt2 from neuraminidase__InfluenzaA__ACQ76403

SEQ ID NO: 108280 - RNA, 1410 nt, Artificial Sequence
  derived and/or modified sequence opt2 from neuraminidase__InfluenzaA__ACQ76407
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108281 - RNA, 1410 nt, Artificial Sequence
  derived and/or modified sequence opt2 from neuraminidase__InfluenzaA__ACQ77603
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 108282 - RNA, 1410 nt, Artificial Sequence; identical to SEQ ID NO: 108240
  derived and/or modified sequence opt2 from neuraminidase__InfluenzaA__ACQ83309

SEQ ID NO: 108283 - RNA, 1410 nt, Artificial Sequence; identical to SEQ ID NO: 108240
  derived and/or modified sequence opt2 from neuraminidase__InfluenzaA__ACQ84460

SEQ ID NO: 108284 - RNA, 1410 nt, Artificial Sequence; identical to SEQ ID NO: 108240
  derived and/or modified sequence opt2 from neuraminidase__InfluenzaA__ACQ84470

SEQ ID NO: 108285 - RNA, 1410 nt, Artificial Sequence
  derived and/or modified sequence opt2 from neuraminidase__InfluenzaA__ACQ84480
augaacaccaaccagcgcaucaucaccaucggcaccgucugccucaucgucggcaucgucucccuccuccuccagaucggcaacaucgucucccucuggaucucccacuccaucaagaccggcgagaagaaccacuccgagaucugcaaccagaacaucaucaccuacgagaacaagaccugggucaaccagaccuacgucaacaucuccaacaccaacaucgccgacggccagggcgucaccuccaucauccucgccggcaacuccucccucugccccaucuccggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaccggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagaucuucaagauggagaagggcaagaucaucaaguccgucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaucaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucgacuccgagaccgccuccugguccuggcccgacggcgccgaccuccccuucaccaucgacaaguga

SEQ ID NO: 108286 - RNA, 1410 nt, Artificial Sequence
  derived and/or modified sequence opt2 from neuraminidase__InfluenzaA__ACQ89891
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugccgcggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108287 - RNA, 1410 nt, Artificial Sequence; identical to SEQ ID NO: 108240
  derived and/or modified sequence opt2 from neuraminidase__InfluenzaA__ACQ89918

SEQ ID NO: 108288 - RNA, 1410 nt, Artificial Sequence
  derived and/or modified sequence opt2 from neuraminidase__InfluenzaA__ACQ89919
augaaccccaaccagaagaucaucaccaucggcuccgucugcaugaccaucggcauggccaaccucauccuccagaucggcaacaucaucuccaucuggaucucccgcuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108289 - RNA, 1410 nt, Artificial Sequence; identical to SEQ ID NO: 108250
  derived and/or modified sequence opt2 from neuraminidase__InfluenzaA__ACQ89920

SEQ ID NO: 108290 - RNA, 1410 nt, Artificial Sequence; identical to SEQ ID NO: 108250
  derived and/or modified sequence opt2 from neuraminidase__InfluenzaA__ACQ89921

SEQ ID NO: 108291 - RNA, 1410 nt, Artificial Sequence; identical to SEQ ID NO: 108240
  derived and/or modified sequence opt2 from neuraminidase__InfluenzaA__ACQ89922

SEQ ID NO: 108292 - RNA, 1410 nt, Artificial Sequence; identical to SEQ ID NO: 108250
  derived and/or modified sequence opt2 from neuraminidase__InfluenzaA__ACQ89923

SEQ ID NO: 108293 - RNA, 1410 nt, Artificial Sequence; identical to SEQ ID NO: 108240
  derived and/or modified sequence opt2 from neuraminidase__InfluenzaA__ACQ99623

SEQ ID NO: 108294 - RNA, 1410 nt, Artificial Sequence; identical to SEQ ID NO: 108250
  derived and/or modified sequence opt2 from neuraminidase__InfluenzaA__ACQ99624

SEQ ID NO: 108295 - RNA, 1410 nt, Artificial Sequence; identical to SEQ ID NO: 108240
  derived and/or modified sequence opt2 from neuraminidase__InfluenzaA__ACQ99626

SEQ ID NO: 108296 - RNA, 1410 nt, Artificial Sequence; identical to SEQ ID NO: 108240
  derived and/or modified sequence opt2 from neuraminidase__InfluenzaA__ACQ99627

SEQ ID NO: 108297 - RNA, 1410 nt, Artificial Sequence; identical to SEQ ID NO: 108240
  derived and/or modified sequence opt2 from neuraminidase__InfluenzaA__ACQ99628

SEQ ID NO: 108298 - RNA, 1410 nt, Artificial Sequence; identical to SEQ ID NO: 108240
  derived and/or modified sequence opt2 from neuraminidase__InfluenzaA__ACQ99629

SEQ ID NO: 108299 - RNA, 1410 nt, Artificial Sequence; identical to SEQ ID NO: 108240
  derived and/or modified sequence opt2 from neuraminidase__InfluenzaA__ACQ99630

SEQ ID NO: 108300 - RNA, 1410 nt, Artificial Sequence; identical to SEQ ID NO: 108250
  derived and/or modified sequence opt2 from neuraminidase__InfluenzaA__ACQ99632

SEQ ID NO: 108301 - RNA, 1410 nt, Artificial Sequence; identical to SEQ ID NO: 108250
  derived and/or modified sequence opt2 from neuraminidase__InfluenzaA__ACQ99633

SEQ ID NO: 108302 - RNA, 1410 nt, Artificial Sequence; identical to SEQ ID NO: 108240
  derived and/or modified sequence opt2 from neuraminidase__InfluenzaA__ACQ99635

SEQ ID NO: 108303 - RNA, 1410 nt, Artificial Sequence; identical to SEQ ID NO: 108240
  derived and/or modified sequence opt2 from neuraminidase__InfluenzaA__ACQ99636

SEQ ID NO: 108304 - RNA, 1410 nt, Artificial Sequence
  derived and/or modified sequence opt2 from neuraminidase__InfluenzaA__ACQ99684
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacgagcaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108305 - RNA, 1410 nt, Artificial Sequence
  derived and/or modified sequence opt2 from neuraminidase__InfluenzaA__ACQ99824
augaacaccaaccagcgcaucaucaccaucggcaccaucugccucaucgucggcaucaucucccuccuccuccagaucggcaacaucauccuccucuggaugucccacuccauccagaccggcgagaagucccaccccaaggucugcaaccaguccgucaucaccuacgagaacaacaccugggucaaccagaccuacgucaacaucuccaacaccaacaucgccgccggccagggcgucacccccaucauccucgccggcaacuccucccucugccccaucuccggcugggccaucuacuccaaggacaacuccauccgcaucggcuccaagggcgacaucuucgucaugcgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagcucuucaagauggagaagggcaagaucaucaaguccaucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucaacuccggcaccgccuccugguccuggcccgacggcgccgaccuccccuucaccaucgacaaguga

SEQ ID NO: 108306 - RNA, 1410 nt, Artificial Sequence; identical to SEQ ID NO: 108250
  derived and/or modified sequence opt2 from neuraminidase__InfluenzaA__ACR01015

SEQ ID NO: 108307 - RNA, 1410 nt, Artificial Sequence; identical to SEQ ID NO: 108250
  derived and/or modified sequence opt2 from neuraminidase__InfluenzaA__ACR08422

SEQ ID NO: 108308 - RNA, 1410 nt, Artificial Sequence; identical to SEQ ID NO: 108250
  derived and/or modified sequence opt2 from neuraminidase__InfluenzaA__ACR08432

SEQ ID NO: 108309 - RNA, 1410 nt, Artificial Sequence; identical to SEQ ID NO: 108250
  derived and/or modified sequence opt2 from neuraminidase__InfluenzaA__ACR08442

SEQ ID NO: 108310 - RNA, 1410 nt, Artificial Sequence; identical to SEQ ID NO: 108250
  derived and/or modified sequence opt2 from neuraminidase__InfluenzaA__ACR08452

SEQ ID NO: 108311 - RNA, 1410 nt, Artificial Sequence
  derived and/or modified sequence opt2 from neuraminidase__InfluenzaA__ACR08462
augucccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108312 - RNA, 1410 nt, Artificial Sequence
  derived and/or modified sequence opt2 from neuraminidase__InfluenzaA__ACR08565
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108313 - RNA, 1410 nt, Artificial Sequence; identical to SEQ ID NO: 108240
  derived and/or modified sequence opt2 from neuraminidase__InfluenzaA__ACR08566

SEQ ID NO: 108314 - RNA, 1410 nt, Artificial Sequence; identical to SEQ ID NO: 108250
  derived and/or modified sequence opt2 from neuraminidase__InfluenzaA__ACR08567

SEQ ID NO: 108315 - RNA, 1410 nt, Artificial Sequence; identical to SEQ ID NO: 108240
  derived and/or modified sequence opt2 from neuraminidase__InfluenzaA__ACR08568

SEQ ID NO: 108316 - RNA, 1410 nt, Artificial Sequence; identical to SEQ ID NO: 108240
  derived and/or modified sequence opt2 from neuraminidase__InfluenzaA__ACR08569

SEQ ID NO: 108317 - RNA, 1410 nt, Artificial Sequence; identical to SEQ ID NO: 108250
  derived and/or modified sequence opt2 from neuraminidase__InfluenzaA__ACR08570

SEQ ID NO: 108318 - RNA, 1410 nt, Artificial Sequence; identical to SEQ ID NO: 108240
  derived and/or modified sequence opt2 from neuraminidase__InfluenzaA__ACR08571

SEQ ID NO: 108319 - RNA, 1410 nt, Artificial Sequence; identical to SEQ ID NO: 108240
  derived and/or modified sequence opt2 from neuraminidase__InfluenzaA__ACR08572

SEQ ID NO: 108320 - RNA, 1410 nt, Artificial Sequence; identical to SEQ ID NO: 108240
  derived and/or modified sequence opt2 from neuraminidase__InfluenzaA__ACR08573

SEQ ID NO: 108321 - RNA, 1410 nt, Artificial Sequence; identical to SEQ ID NO: 108240
  derived and/or modified sequence opt2 from neuraminidase__InfluenzaA__ACR08574

SEQ ID NO: 108322 - RNA, 1410 nt, Artificial Sequence; identical to SEQ ID NO: 108250
  derived and/or modified sequence opt2 from neuraminidase__InfluenzaA__ACR08576

SEQ ID NO: 108323 - RNA, 1410 nt, Artificial Sequence; identical to SEQ ID NO: 108240
  derived and/or modified sequence opt2 from neuraminidase__InfluenzaA__ACR08577

SEQ ID NO: 108324 - RNA, 1410 nt, Artificial Sequence; identical to SEQ ID NO: 108240
  derived and/or modified sequence opt2 from neuraminidase__InfluenzaA__ACR09378

SEQ ID NO: 108325 - RNA, 1410 nt, Artificial Sequence; identical to SEQ ID NO: 108240
  derived and/or modified sequence opt2 from neuraminidase__InfluenzaA__ACR09379

SEQ ID NO: 108326 - RNA, 1410 nt, Artificial Sequence; identical to SEQ ID NO: 108250
  derived and/or modified sequence opt2 from neuraminidase__InfluenzaA__ACR09380

SEQ ID NO: 108327 - RNA, 1410 nt, Artificial Sequence; identical to SEQ ID NO: 108240
  derived and/or modified sequence opt2 from neuraminidase__InfluenzaA__ACR09381

SEQ ID NO: 108328 - RNA, 1410 nt, Artificial Sequence; identical to SEQ ID NO: 108240
  derived and/or modified sequence opt2 from neuraminidase__InfluenzaA__ACR09382

SEQ ID NO: 108329 - RNA, 1410 nt, Artificial Sequence; identical to SEQ ID NO: 108250
  derived and/or modified sequence opt2 from neuraminidase__InfluenzaA__ACR09383

SEQ ID NO: 108330 - RNA, 1410 nt, Artificial Sequence; identical to SEQ ID NO: 108240
  derived and/or modified sequence opt2 from neuraminidase__InfluenzaA__ACR09384

SEQ ID NO: 108331 - RNA, 1410 nt, Artificial Sequence; identical to SEQ ID NO: 108250
  derived and/or modified sequence opt2 from neuraminidase__InfluenzaA__ACR09385

SEQ ID NO: 108332 - RNA, 1410 nt, Artificial Sequence; identical to SEQ ID NO: 108240
  derived and/or modified sequence opt2 from neuraminidase__InfluenzaA__ACR09386

SEQ ID NO: 108333 - RNA, 1410 nt, Artificial Sequence; identical to SEQ ID NO: 108250
  derived and/or modified sequence opt2 from neuraminidase__InfluenzaA__ACR10189

SEQ ID NO: 108334 - RNA, 1410 nt, Artificial Sequence; identical to SEQ ID NO: 108250
  derived and/or modified sequence opt2 from neuraminidase__InfluenzaA__ACR10226

SEQ ID NO: 108335 - RNA, 1410 nt, Artificial Sequence; identical to SEQ ID NO: 108240
  derived and/or modified sequence opt2 from neuraminidase__InfluenzaA__ACR10236

SEQ ID NO: 108336 - RNA, 1410 nt, Artificial Sequence; identical to SEQ ID NO: 108240
  derived and/or modified sequence opt2 from neuraminidase__InfluenzaA__ACR10237

SEQ ID NO: 108337 - RNA, 1410 nt, Artificial Sequence
  derived and/or modified sequence opt2 from neuraminidase__InfluenzaA__ACR15186
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgccaccccggcguccgcugcgucugccgcgacaacuggcgcggcuccaaccgccccaucgucgacaucaacaugaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108338 - RNA, 1413 nt, Artificial Sequence; identical to SEQ ID NO: 108144
  derived and/or modified sequence opt2 from neuraminidase__InfluenzaA__ACR15197

SEQ ID NO: 108339 - RNA, 1410 nt, Artificial Sequence
  derived and/or modified sequence opt2 from neuraminidase__InfluenzaA__ACR15208
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108340 - RNA, 1410 nt, Artificial Sequence
  derived and/or modified sequence opt2 from neuraminidase__InfluenzaA__ACR15230
auggaccccaaccagaagaucaucaccaucggcuccgucucccucaccaucuccgccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccaacucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108341 - RNA, 1413 nt, Artificial Sequence; identical to SEQ ID NO: 108144
  derived and/or modified sequence opt2 from neuraminidase__InfluenzaA__ACR15241

SEQ ID NO: 108342 - RNA, 1410 nt, Artificial Sequence; identical to SEQ ID NO: 107396
  derived and/or modified sequence opt2 from neuraminidase__InfluenzaA__ACR15252

SEQ ID NO: 108343 - RNA, 1413 nt, Artificial Sequence
  derived and/or modified sequence opt2 from neuraminidase__InfluenzaA__ACR15263
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucugguccuccggcuccuccaucuccuucugcggcgucaacuccgacaccgccaacugguccuggcccgacggcgccgagcuccccuucaccaucgacaaguga

SEQ ID NO: 108344 - RNA, 1413 nt, Artificial Sequence; identical to SEQ ID NO: 108144
  derived and/or modified sequence opt2 from neuraminidase__InfluenzaA__ACR15274

SEQ ID NO: 108345 - RNA, 1413 nt, Artificial Sequence
  derived and/or modified sequence opt2 from neuraminidase__InfluenzaA__ACR15307
augaaccccaaccagaagaucaucaccaucggcuccaucuccaucaccaucggcaucaucucccucaugcuccagaucggcaacaucaucuccaucugggccucccacuccauccagaccggcucccagaaccacaccggcaucugcaaccagcgcaucaucaccuacgagaacaacaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108346 - RNA, 1413 nt, Artificial Sequence
  derived and/or modified sequence opt2 from neuraminidase__InfluenzaA__ACR15318
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagcgccagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 108347 - RNA, 1413 nt, Artificial Sequence
  derived and/or modified sequence opt2 from neuraminidase__InfluenzaA__ACR15329
augaaccccaaccagaagaucaucaccaucggcuccaucuccaucgccaucggcaucaucucccucaugcuccagaucggcaacaucaucuccaucugggccucccacuccauccagacccgcucccagaaccacaccggcgucugcaaccagcgcaucaucaccuacgagaacuccaccugggucaaccacaccuacgucaacaucaacaacaccaacgucaucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 108348 - RNA, 1413 nt, Artificial Sequence; identical to SEQ ID NO: 108144
  derived and/or modified sequence opt2 from neuraminidase__InfluenzaA__ACR15340

SEQ ID NO: 108349 - RNA, 1413 nt, Artificial Sequence; identical to SEQ ID NO: 108144
  derived and/or modified sequence opt2 from neuraminidase__InfluenzaA__ACR15362

SEQ ID NO: 108350 - RNA, 1413 nt, Artificial Sequence; identical to SEQ ID NO: 108144
  derived and/or modified sequence opt2 from neuraminidase__InfluenzaA__ACR15373

SEQ ID NO: 108351 - RNA, 1413 nt, Artificial Sequence
  derived and/or modified sequence opt2 from neuraminidase__InfluenzaA__ACR15428
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccgucuccggcugggccaucuacaccaaggacaacuccauccgcaucggcuccaagggcgacgucuucgucauccgcgagcccuucaucuccugcucccaccucgagugccgcaccuucuuccucaccaagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108352 - RNA, 1413 nt, Artificial Sequence
  derived and/or modified sequence opt2 from neuraminidase__InfluenzaA__ACR15472
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagacccccgucacccucgccggcaacuccucccucugcuccaucuccggcugggccaucuacaccaaggacaacuccauccgcaucggcuccaagggcgacgucuucgucauccgcgagcccuucaucgccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgaggucaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108353 - RNA, 1413 nt, Artificial Sequence; identical to SEQ ID NO: 108144
  derived and/or modified sequence opt2 from neuraminidase__InfluenzaA__ACR15483

SEQ ID NO: 108354 - RNA, 1413 nt, Artificial Sequence; identical to SEQ ID NO: 108144
  derived and/or modified sequence opt2 from neuraminidase__InfluenzaA__ACR15505

SEQ ID NO: 108355 - RNA, 1413 nt, Artificial Sequence; identical to SEQ ID NO: 108228
  derived and/or modified sequence opt2 from neuraminidase__InfluenzaA__ACR15516

SEQ ID NO: 108356 - RNA, 1410 nt, Artificial Sequence; identical to SEQ ID NO: 106226
  derived and/or modified sequence opt2 from neuraminidase__InfluenzaA__ACR15527

SEQ ID NO: 108357 - RNA, 1410 nt, Artificial Sequence
  derived and/or modified sequence opt2 from neuraminidase__InfluenzaA__ACR15538
augauccccauccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108358 - RNA, 1410 nt, Artificial Sequence; identical to SEQ ID NO: 105839
  derived and/or modified sequence opt2 from neuraminidase__InfluenzaA__ACR15549

SEQ ID NO: 108359 - RNA, 1410 nt, Artificial Sequence; identical to SEQ ID NO: 106224
  derived and/or modified sequence opt2 from neuraminidase__InfluenzaA__ACR15560

SEQ ID NO: 108360 - RNA, 1410 nt, Artificial Sequence; identical to SEQ ID NO: 106224
  derived and/or modified sequence opt2 from neuraminidase__InfluenzaA__ACR15582

SEQ ID NO: 108361 - RNA, 1410 nt, Artificial Sequence
  derived and/or modified sequence opt2 from neuraminidase__InfluenzaA__ACR15593
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcaggccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108362 - RNA, 1410 nt, Artificial Sequence
  derived and/or modified sequence opt2 from neuraminidase__InfluenzaA__ACR15604
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108363 - RNA, 1410 nt, Artificial Sequence; identical to SEQ ID NO: 108240
  derived and/or modified sequence opt2 from neuraminidase__InfluenzaA__ACR15618

SEQ ID NO: 108364 - RNA, 1410 nt, Artificial Sequence; identical to SEQ ID NO: 108240
  derived and/or modified sequence opt2 from neuraminidase__InfluenzaA__ACR18924

SEQ ID NO: 108365 - RNA, 1410 nt, Artificial Sequence; identical to SEQ ID NO: 108240
  derived and/or modified sequence opt2 from neuraminidase__InfluenzaA__ACR18925

SEQ ID NO: 108366 - RNA, 1410 nt, Artificial Sequence; identical to SEQ ID NO: 108250
  derived and/or modified sequence opt2 from neuraminidase__InfluenzaA__ACR18926

SEQ ID NO: 108367 - RNA, 1410 nt, Artificial Sequence; identical to SEQ ID NO: 108250
  derived and/or modified sequence opt2 from neuraminidase__InfluenzaA__ACR18927

SEQ ID NO: 108368 - RNA, 1410 nt, Artificial Sequence; identical to SEQ ID NO: 108250
  derived and/or modified sequence opt2 from neuraminidase__InfluenzaA__ACR18928

SEQ ID NO: 108369 - RNA, 1410 nt, Artificial Sequence; identical to SEQ ID NO: 108250
  derived and/or modified sequence opt2 from neuraminidase__InfluenzaA__ACR18929

SEQ ID NO: 108370 - RNA, 1410 nt, Artificial Sequence; identical to SEQ ID NO: 108250
  derived and/or modified sequence opt2 from neuraminidase__InfluenzaA__ACR18930

SEQ ID NO: 108371 - RNA, 1410 nt, Artificial Sequence; identical to SEQ ID NO: 108250
  derived and/or modified sequence opt2 from neuraminidase__InfluenzaA__ACR18931

SEQ ID NO: 108372 - RNA, 1410 nt, Artificial Sequence; identical to SEQ ID NO: 108250
  derived and/or modified sequence opt2 from neuraminidase__InfluenzaA__ACR18933

SEQ ID NO: 108373 - RNA, 1410 nt, Artificial Sequence; identical to SEQ ID NO: 108240
  derived and/or modified sequence opt2 from neuraminidase__InfluenzaA__ACR18934

SEQ ID NO: 108374 - RNA, 1410 nt, Artificial Sequence; identical to SEQ ID NO: 108250
  derived and/or modified sequence opt2 from neuraminidase__InfluenzaA__ACR18935

SEQ ID NO: 108375 - RNA, 1410 nt, Artificial Sequence; identical to SEQ ID NO: 108250
  derived and/or modified sequence opt2 from neuraminidase__InfluenzaA__ACR23301

SEQ ID NO: 108376 - RNA, 1410 nt, Artificial Sequence; identical to SEQ ID NO: 108250
  derived and/or modified sequence opt2 from neuraminidase__InfluenzaA__ACR32997

SEQ ID NO: 108377 - RNA, 1410 nt, Artificial Sequence
  derived and/or modified sequence opt2 from neuraminidase__InfluenzaA__ACR33740
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 108378 - RNA, 1410 nt, Artificial Sequence; identical to SEQ ID NO: 108240
  derived and/or modified sequence opt2 from neuraminidase__InfluenzaA__ACR38792

SEQ ID NO: 108379 - RNA, 1410 nt, Artificial Sequence; identical to SEQ ID NO: 108250
  derived and/or modified sequence opt2 from neuraminidase__InfluenzaA__ACR38793

SEQ ID NO: 108380 - RNA, 1410 nt, Artificial Sequence; identical to SEQ ID NO: 108250
  derived and/or modified sequence opt2 from neuraminidase__InfluenzaA__ACR38794

SEQ ID NO: 108381 - RNA, 1410 nt, Artificial Sequence; identical to SEQ ID NO: 108250
  derived and/or modified sequence opt2 from neuraminidase__InfluenzaA__ACR38878

SEQ ID NO: 108382 - RNA, 1410 nt, Artificial Sequence; identical to SEQ ID NO: 108250
  derived and/or modified sequence opt2 from neuraminidase__InfluenzaA__ACR39357

SEQ ID NO: 108383 - RNA, 1410 nt, Artificial Sequence; identical to SEQ ID NO: 108250
  derived and/or modified sequence opt2 from neuraminidase__InfluenzaA__ACR39396

SEQ ID NO: 108384 - RNA, 1410 nt, Artificial Sequence; identical to SEQ ID NO: 108250
  derived and/or modified sequence opt2 from neuraminidase__InfluenzaA__ACR39406

SEQ ID NO: 108385 - RNA, 1410 nt, Artificial Sequence; identical to SEQ ID NO: 108250
  derived and/or modified sequence opt2 from neuraminidase__InfluenzaA__ACR39416

SEQ ID NO: 108386 - RNA, 1410 nt, Artificial Sequence; identical to SEQ ID NO: 108250
  derived and/or modified sequence opt2 from neuraminidase__InfluenzaA__ACR39426

SEQ ID NO: 108387 - RNA, 1410 nt, Artificial Sequence; identical to SEQ ID NO: 108250
  derived and/or modified sequence opt2 from neuraminidase__InfluenzaA__ACR39436

SEQ ID NO: 108388 - RNA, 1410 nt, Artificial Sequence; identical to SEQ ID NO: 108250
  derived and/or modified sequence opt2 from neuraminidase__InfluenzaA__ACR39446

SEQ ID NO: 108389 - RNA, 1410 nt, Artificial Sequence; identical to SEQ ID NO: 108250
  derived and/or modified sequence opt2 from neuraminidase__InfluenzaA__ACR39456

SEQ ID NO: 108390 - RNA, 1410 nt, Artificial Sequence; identical to SEQ ID NO: 108250
  derived and/or modified sequence opt2 from neuraminidase__InfluenzaA__ACR39466

SEQ ID NO: 108391 - RNA, 1410 nt, Artificial Sequence; identical to SEQ ID NO: 108250
  derived and/or modified sequence opt2 from neuraminidase__InfluenzaA__ACR39476

SEQ ID NO: 108392 - RNA, 1410 nt, Artificial Sequence; identical to SEQ ID NO: 108250
  derived and/or modified sequence opt2 from neuraminidase__InfluenzaA__ACR39486

SEQ ID NO: 108393 - RNA, 1410 nt, Artificial Sequence; identical to SEQ ID NO: 108250
  derived and/or modified sequence opt2 from neuraminidase__InfluenzaA__ACR39496

SEQ ID NO: 108394 - RNA, 1410 nt, Artificial Sequence; identical to SEQ ID NO: 108250
  derived and/or modified sequence opt2 from neuraminidase__InfluenzaA__ACR40291

SEQ ID NO: 108395 - RNA, 1410 nt, Artificial Sequence; identical to SEQ ID NO: 108250
  derived and/or modified sequence opt2 from neuraminidase__InfluenzaA__ACR40301

SEQ ID NO: 108396 - RNA, 1410 nt, Artificial Sequence
  derived and/or modified sequence opt2 from neuraminidase__InfluenzaA__ACR40311
augaaccccaaccagaagaucaucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108397 - RNA, 1410 nt, Artificial Sequence
  derived and/or modified sequence opt2 from neuraminidase__InfluenzaA__ACR40321
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaacggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108398 - RNA, 1410 nt, Artificial Sequence; identical to SEQ ID NO: 108250
  derived and/or modified sequence opt2 from neuraminidase__InfluenzaA__ACR40341

SEQ ID NO: 108399 - RNA, 1410 nt, Artificial Sequence; identical to SEQ ID NO: 108250
  derived and/or modified sequence opt2 from neuraminidase__InfluenzaA__ACR40351

SEQ ID NO: 108400 - RNA, 1410 nt, Artificial Sequence; identical to SEQ ID NO: 108250
  derived and/or modified sequence opt2 from neuraminidase__InfluenzaA__ACR40361

SEQ ID NO: 108401 - RNA, 1410 nt, Artificial Sequence; identical to SEQ ID NO: 108250
  derived and/or modified sequence opt2 from neuraminidase__InfluenzaA__ACR40371

SEQ ID NO: 108402 - RNA, 1410 nt, Artificial Sequence; identical to SEQ ID NO: 108250
  derived and/or modified sequence opt2 from neuraminidase__InfluenzaA__ACR40391

SEQ ID NO: 108403 - RNA, 1410 nt, Artificial Sequence; identical to SEQ ID NO: 108240
  derived and/or modified sequence opt2 from neuraminidase__InfluenzaA__ACR46663

SEQ ID NO: 108404 - RNA, 1410 nt, Artificial Sequence; identical to SEQ ID NO: 108240
  derived and/or modified sequence opt2 from neuraminidase__InfluenzaA__ACR46673

SEQ ID NO: 108405 - RNA, 1410 nt, Artificial Sequence
  derived and/or modified sequence opt2 from neuraminidase__InfluenzaA__ACR46996
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108406 - RNA, 1410 nt, Artificial Sequence; identical to SEQ ID NO: 108405
  derived and/or modified sequence opt2 from neuraminidase__InfluenzaA__ACR46997

SEQ ID NO: 108407 - RNA, 1410 nt, Artificial Sequence; identical to SEQ ID NO: 108405
  derived and/or modified sequence opt2 from neuraminidase__InfluenzaA__ACR46998

SEQ ID NO: 108408 - RNA, 1410 nt, Artificial Sequence; identical to SEQ ID NO: 108405
  derived and/or modified sequence opt2 from neuraminidase__InfluenzaA__ACR46999

SEQ ID NO: 108409 - RNA, 1410 nt, Artificial Sequence; identical to SEQ ID NO: 108405
  derived and/or modified sequence opt2 from neuraminidase__InfluenzaA__ACR47000

SEQ ID NO: 108410 - RNA, 1410 nt, Artificial Sequence; identical to SEQ ID NO: 108405
  derived and/or modified sequence opt2 from neuraminidase__InfluenzaA__ACR47001

SEQ ID NO: 108411 - RNA, 1410 nt, Artificial Sequence; identical to SEQ ID NO: 108405
  derived and/or modified sequence opt2 from neuraminidase__InfluenzaA__ACR47002

SEQ ID NO: 108412 - RNA, 1410 nt, Artificial Sequence; identical to SEQ ID NO: 108405
  derived and/or modified sequence opt2 from neuraminidase__InfluenzaA__ACR47003

SEQ ID NO: 108413 - RNA, 1410 nt, Artificial Sequence
  derived and/or modified sequence opt2 from neuraminidase__InfluenzaA__ACR47008
augaaccccaaccagaagaucaucaccaucggcuccgucugcaugaccaucggcauggccaaccucauccuccagaucggcaacaucaucuccaucuggcccguccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108414 - RNA, 1410 nt, Artificial Sequence; identical to SEQ ID NO: 108250
  derived and/or modified sequence opt2 from neuraminidase__InfluenzaA__ACR49267

SEQ ID NO: 108415 - RNA, 1410 nt, Artificial Sequence; identical to SEQ ID NO: 108240
  derived and/or modified sequence opt2 from neuraminidase__InfluenzaA__ACR49268

SEQ ID NO: 108416 - RNA, 1410 nt, Artificial Sequence; identical to SEQ ID NO: 108240
  derived and/or modified sequence opt2 from neuraminidase__InfluenzaA__ACR49269

SEQ ID NO: 108417 - RNA, 1410 nt, Artificial Sequence; identical to SEQ ID NO: 108240
  derived and/or modified sequence opt2 from neuraminidase__InfluenzaA__ACR49270

SEQ ID NO: 108418 - RNA, 1410 nt, Artificial Sequence; identical to SEQ ID NO: 108280
  derived and/or modified sequence opt2 from neuraminidase__InfluenzaA__ACR49271

SEQ ID NO: 108419 - RNA, 1410 nt, Artificial Sequence; identical to SEQ ID NO: 108250
  derived and/or modified sequence opt2 from neuraminidase__InfluenzaA__ACR49272

SEQ ID NO: 108420 - RNA, 1410 nt, Artificial Sequence; identical to SEQ ID NO: 108240
  derived and/or modified sequence opt2 from neuraminidase__InfluenzaA__ACR49273

SEQ ID NO: 108421 - RNA, 1410 nt, Artificial Sequence; identical to SEQ ID NO: 108240
  derived and/or modified sequence opt2 from neuraminidase__InfluenzaA__ACR49274

SEQ ID NO: 108422 - RNA, 1410 nt, Artificial Sequence; identical to SEQ ID NO: 108280
  derived and/or modified sequence opt2 from neuraminidase__InfluenzaA__ACR49275

SEQ ID NO: 108423 - RNA, 1410 nt, Artificial Sequence; identical to SEQ ID NO: 108280
  derived and/or modified sequence opt2 from neuraminidase__InfluenzaA__ACR49277

SEQ ID NO: 108424 - RNA, 1410 nt, Artificial Sequence; identical to SEQ ID NO: 108280
  derived and/or modified sequence opt2 from neuraminidase__InfluenzaA__ACR49278

SEQ ID NO: 108425 - RNA, 1410 nt, Artificial Sequence; identical to SEQ ID NO: 108240
  derived and/or modified sequence opt2 from neuraminidase__InfluenzaA__ACR49279

SEQ ID NO: 108426 - RNA, 1410 nt, Artificial Sequence; identical to SEQ ID NO: 108240
  derived and/or modified sequence opt2 from neuraminidase__InfluenzaA__ACR50994

SEQ ID NO: 108427 - RNA, 1410 nt, Artificial Sequence; identical to SEQ ID NO: 108250
  derived and/or modified sequence opt2 from neuraminidase__InfluenzaA__ACR50998

SEQ ID NO: 108428 - RNA, 1410 nt, Artificial Sequence; identical to SEQ ID NO: 108250
  derived and/or modified sequence opt2 from neuraminidase__InfluenzaA__ACR51008

SEQ ID NO: 108429 - RNA, 1410 nt, Artificial Sequence; identical to SEQ ID NO: 108250
  derived and/or modified sequence opt2 from neuraminidase__InfluenzaA__ACR51018

SEQ ID NO: 108430 - RNA, 1410 nt, Artificial Sequence; identical to SEQ ID NO: 108250
  derived and/or modified sequence opt2 from neuraminidase__InfluenzaA__ACR51028

SEQ ID NO: 108431 - RNA, 1410 nt, Artificial Sequence
  derived and/or modified sequence opt2 from neuraminidase__InfluenzaA__ACR51038
augaaccccaaccagaagaucaucaccaucggcuccgucugcauguccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108432 - RNA, 1410 nt, Artificial Sequence; identical to SEQ ID NO: 108250
  derived and/or modified sequence opt2 from neuraminidase__InfluenzaA__ACR51048

SEQ ID NO: 108433 - RNA, 1410 nt, Artificial Sequence; identical to SEQ ID NO: 108250
  derived and/or modified sequence opt2 from neuraminidase__InfluenzaA__ACR51058

SEQ ID NO: 108434 - RNA, 1410 nt, Artificial Sequence; identical to SEQ ID NO: 108240
  derived and/or modified sequence opt2 from neuraminidase__InfluenzaA__ACR51068

SEQ ID NO: 108435 - RNA, 1410 nt, Artificial Sequence; identical to SEQ ID NO: 108250
  derived and/or modified sequence opt2 from neuraminidase__InfluenzaA__ACR52371

SEQ ID NO: 108436 - RNA, 1410 nt, Artificial Sequence; identical to SEQ ID NO: 108250
  derived and/or modified sequence opt2 from neuraminidase__InfluenzaA__ACR52381

SEQ ID NO: 108437 - RNA, 1410 nt, Artificial Sequence; identical to SEQ ID NO: 108250
  derived and/or modified sequence opt2 from neuraminidase__InfluenzaA__ACR52391

SEQ ID NO: 108438 - RNA, 1410 nt, Artificial Sequence; identical to SEQ ID NO: 108250
  derived and/or modified sequence opt2 from neuraminidase__InfluenzaA__ACR52401

SEQ ID NO: 108439 - RNA, 1410 nt, Artificial Sequence; identical to SEQ ID NO: 108250
  derived and/or modified sequence opt2 from neuraminidase__InfluenzaA__ACR52411

SEQ ID NO: 108440 - RNA, 1410 nt, Artificial Sequence; identical to SEQ ID NO: 108250
  derived and/or modified sequence opt2 from neuraminidase__InfluenzaA__ACR52421

SEQ ID NO: 108441 - RNA, 1410 nt, Artificial Sequence; identical to SEQ ID NO: 108250
  derived and/or modified sequence opt2 from neuraminidase__InfluenzaA__ACR52431

SEQ ID NO: 108442 - RNA, 1410 nt, Artificial Sequence; identical to SEQ ID NO: 108250
  derived and/or modified sequence opt2 from neuraminidase__InfluenzaA__ACR52441

SEQ ID NO: 108443 - RNA, 1410 nt, Artificial Sequence; identical to SEQ ID NO: 108250
  derived and/or modified sequence opt2 from neuraminidase__InfluenzaA__ACR52451

SEQ ID NO: 108444 - RNA, 1410 nt, Artificial Sequence; identical to SEQ ID NO: 108250
  derived and/or modified sequence opt2 from neuraminidase__InfluenzaA__ACR52471

SEQ ID NO: 108445 - RNA, 1410 nt, Artificial Sequence; identical to SEQ ID NO: 108250
  derived and/or modified sequence opt2 from neuraminidase__InfluenzaA__ACR52481

SEQ ID NO: 108446 - RNA, 1410 nt, Artificial Sequence; identical to SEQ ID NO: 108250
  derived and/or modified sequence opt2 from neuraminidase__InfluenzaA__ACR52491

SEQ ID NO: 108447 - RNA, 1410 nt, Artificial Sequence; identical to SEQ ID NO: 108250
  derived and/or modified sequence opt2 from neuraminidase__InfluenzaA__ACR54046

SEQ ID NO: 108448 - RNA, 1410 nt, Artificial Sequence; identical to SEQ ID NO: 108240
  derived and/or modified sequence opt2 from neuraminidase__InfluenzaA__ACR54052

SEQ ID NO: 108449 - RNA, 1410 nt, Artificial Sequence; identical to SEQ ID NO: 108250
  derived and/or modified sequence opt2 from neuraminidase__InfluenzaA__ACR54966

SEQ ID NO: 108450 - RNA, 1410 nt, Artificial Sequence; identical to SEQ ID NO: 108250
  derived and/or modified sequence opt2 from neuraminidase__InfluenzaA__ACR54976

SEQ ID NO: 108451 - RNA, 1410 nt, Artificial Sequence; identical to SEQ ID NO: 108250
  derived and/or modified sequence opt2 from neuraminidase__InfluenzaA__ACR54986

SEQ ID NO: 108452 - RNA, 1410 nt, Artificial Sequence; identical to SEQ ID NO: 108240
  derived and/or modified sequence opt2 from neuraminidase__InfluenzaA__ACR54996

SEQ ID NO: 108453 - RNA, 1410 nt, Artificial Sequence; identical to SEQ ID NO: 108250
  derived and/or modified sequence opt2 from neuraminidase__InfluenzaA__ACR55006

SEQ ID NO: 108454 - RNA, 1410 nt, Artificial Sequence; identical to SEQ ID NO: 108240
  derived and/or modified sequence opt2 from neuraminidase__InfluenzaA__ACR56383

SEQ ID NO: 108455 - RNA, 1410 nt, Artificial Sequence; identical to SEQ ID NO: 108240
  derived and/or modified sequence opt2 from neuraminidase__InfluenzaA__ACR56393

SEQ ID NO: 108456 - RNA, 1410 nt, Artificial Sequence; identical to SEQ ID NO: 108250
  derived and/or modified sequence opt2 from neuraminidase__InfluenzaA__ACR56403

SEQ ID NO: 108457 - RNA, 1410 nt, Artificial Sequence; identical to SEQ ID NO: 108250
  derived and/or modified sequence opt2 from neuraminidase__InfluenzaA__ACR56413

SEQ ID NO: 108458 - RNA, 1410 nt, Artificial Sequence; identical to SEQ ID NO: 108250
  derived and/or modified sequence opt2 from neuraminidase__InfluenzaA__ACR56423

SEQ ID NO: 108459 - RNA, 1410 nt, Artificial Sequence; identical to SEQ ID NO: 108250
  derived and/or modified sequence opt2 from neuraminidase__InfluenzaA__ACR56433

SEQ ID NO: 108460 - RNA, 1410 nt, Artificial Sequence; identical to SEQ ID NO: 108250
  derived and/or modified sequence opt2 from neuraminidase__InfluenzaA__ACR56443

SEQ ID NO: 108461 - RNA, 1410 nt, Artificial Sequence; identical to SEQ ID NO: 108250
  derived and/or modified sequence opt2 from neuraminidase__InfluenzaA__ACR56453

SEQ ID NO: 108462 - RNA, 1413 nt, Artificial Sequence; identical to SEQ ID NO: 108228
  derived and/or modified sequence opt2 from neuraminidase__InfluenzaA__ACR58555

SEQ ID NO: 108463 - RNA, 1413 nt, Artificial Sequence
  derived and/or modified sequence opt2 from neuraminidase__InfluenzaA__ACR61658
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucuccaucaacaacaccaacgucgucaccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 108464 - RNA, 1410 nt, Artificial Sequence
  derived and/or modified sequence opt2 from neuraminidase__InfluenzaA__ACR61680
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaucgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108465 - RNA, 1410 nt, Artificial Sequence
  derived and/or modified sequence opt2 from neuraminidase__InfluenzaA__ACR61691
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccacaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108466 - RNA, 1410 nt, Artificial Sequence
  derived and/or modified sequence opt2 from neuraminidase__InfluenzaA__ACR61702
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccuccaacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108467 - RNA, 1410 nt, Artificial Sequence; identical to SEQ ID NO: 108240
  derived and/or modified sequence opt2 from neuraminidase__InfluenzaA__ACR67201

SEQ ID NO: 108468 - RNA, 1410 nt, Artificial Sequence; identical to SEQ ID NO: 108250
  derived and/or modified sequence opt2 from neuraminidase__InfluenzaA__ACR67202

SEQ ID NO: 108469 - RNA, 1410 nt, Artificial Sequence; identical to SEQ ID NO: 108240
  derived and/or modified sequence opt2 from neuraminidase__InfluenzaA__ACR67203

SEQ ID NO: 108470 - RNA, 1410 nt, Artificial Sequence; identical to SEQ ID NO: 108250
  derived and/or modified sequence opt2 from neuraminidase__InfluenzaA__ACR67204

SEQ ID NO: 108471 - RNA, 1410 nt, Artificial Sequence; identical to SEQ ID NO: 108250
  derived and/or modified sequence opt2 from neuraminidase__InfluenzaA__ACR67246

SEQ ID NO: 108472 - RNA, 1410 nt, Artificial Sequence; identical to SEQ ID NO: 108240
  derived and/or modified sequence opt2 from neuraminidase__InfluenzaA__ACR67256

SEQ ID NO: 108473 - RNA, 1410 nt, Artificial Sequence; identical to SEQ ID NO: 108250
  derived and/or modified sequence opt2 from neuraminidase__InfluenzaA__ACR77451

SEQ ID NO: 108474 - RNA, 1410 nt, Artificial Sequence; identical to SEQ ID NO: 108250
  derived and/or modified sequence opt2 from neuraminidase__InfluenzaA__ACR77461

SEQ ID NO: 108475 - RNA, 1410 nt, Artificial Sequence; identical to SEQ ID NO: 108250
  derived and/or modified sequence opt2 from neuraminidase__InfluenzaA__ACR77471

SEQ ID NO: 108476 - RNA, 1410 nt, Artificial Sequence; identical to SEQ ID NO: 108250
  derived and/or modified sequence opt2 from neuraminidase__InfluenzaA__ACR77481

SEQ ID NO: 108477 - RNA, 1410 nt, Artificial Sequence; identical to SEQ ID NO: 108250
  derived and/or modified sequence opt2 from neuraminidase__InfluenzaA__ACR77491

SEQ ID NO: 108478 - RNA, 1410 nt, Artificial Sequence; identical to SEQ ID NO: 108250
  derived and/or modified sequence opt2 from neuraminidase__InfluenzaA__ACR77501

SEQ ID NO: 108479 - RNA, 1410 nt, Artificial Sequence; identical to SEQ ID NO: 108250
  derived and/or modified sequence opt2 from neuraminidase__InfluenzaA__ACR83527

SEQ ID NO: 108480 - RNA, 1410 nt, Artificial Sequence; identical to SEQ ID NO: 108250
  derived and/or modified sequence opt2 from neuraminidase__InfluenzaA__ACR83539

SEQ ID NO: 108481 - RNA, 1410 nt, Artificial Sequence; identical to SEQ ID NO: 108250
  derived and/or modified sequence opt2 from neuraminidase__InfluenzaA__ACS14669

SEQ ID NO: 108482 - RNA, 1410 nt, Artificial Sequence; identical to SEQ ID NO: 108250
  derived and/or modified sequence opt2 from neuraminidase__InfluenzaA__ACS14679

SEQ ID NO: 108483 - RNA, 1410 nt, Artificial Sequence; identical to SEQ ID NO: 108250
  derived and/or modified sequence opt2 from neuraminidase__InfluenzaA__ACS14689

SEQ ID NO: 108484 - RNA, 1410 nt, Artificial Sequence; identical to SEQ ID NO: 108250
  derived and/or modified sequence opt2 from neuraminidase__InfluenzaA__ACS14699

SEQ ID NO: 108485 - RNA, 1410 nt, Artificial Sequence; identical to SEQ ID NO: 108250
  derived and/or modified sequence opt2 from neuraminidase__InfluenzaA__ACS14709

SEQ ID NO: 108486 - RNA, 1410 nt, Artificial Sequence; identical to SEQ ID NO: 108250
  derived and/or modified sequence opt2 from neuraminidase__InfluenzaA__ACS14719

SEQ ID NO: 108487 - RNA, 1410 nt, Artificial Sequence; identical to SEQ ID NO: 108250
  derived and/or modified sequence opt2 from neuraminidase__InfluenzaA__ACS14729

SEQ ID NO: 108488 - RNA, 1410 nt, Artificial Sequence; identical to SEQ ID NO: 108250
  derived and/or modified sequence opt2 from neuraminidase__InfluenzaA__ACS14739

SEQ ID NO: 108489 - RNA, 1410 nt, Artificial Sequence; identical to SEQ ID NO: 108240
  derived and/or modified sequence opt2 from neuraminidase__InfluenzaA__ACS27192

SEQ ID NO: 108490 - RNA, 1410 nt, Artificial Sequence; identical to SEQ ID NO: 108250
  derived and/or modified sequence opt2 from neuraminidase__InfluenzaA__ACS27202

SEQ ID NO: 108491 - RNA, 1410 nt, Artificial Sequence; identical to SEQ ID NO: 108250
  derived and/or modified sequence opt2 from neuraminidase__InfluenzaA__ACS27212

SEQ ID NO: 108492 - RNA, 1410 nt, Artificial Sequence; identical to SEQ ID NO: 108240
  derived and/or modified sequence opt2 from neuraminidase__InfluenzaA__ACS27222

SEQ ID NO: 108493 - RNA, 1410 nt, Artificial Sequence; identical to SEQ ID NO: 108250
  derived and/or modified sequence opt2 from neuraminidase__InfluenzaA__ACS27232

SEQ ID NO: 108494 - RNA, 1410 nt, Artificial Sequence; identical to SEQ ID NO: 108240
  derived and/or modified sequence opt2 from neuraminidase__InfluenzaA__ACS27242

SEQ ID NO: 108495 - RNA, 1410 nt, Artificial Sequence; identical to SEQ ID NO: 108250
  derived and/or modified sequence opt2 from neuraminidase__InfluenzaA__ACS27252

SEQ ID NO: 108496 - RNA, 1410 nt, Artificial Sequence; identical to SEQ ID NO: 108240
  derived and/or modified sequence opt2 from neuraminidase__InfluenzaA__ACS27771

SEQ ID NO: 108497 - RNA, 1410 nt, Artificial Sequence; identical to SEQ ID NO: 108405
  derived and/or modified sequence opt2 from neuraminidase__InfluenzaA__ACS34969

SEQ ID NO: 108498 - RNA, 1410 nt, Artificial Sequence; identical to SEQ ID NO: 108405
  derived and/or modified sequence opt2 from neuraminidase__InfluenzaA__ACS34970

SEQ ID NO: 108499 - RNA, 1410 nt, Artificial Sequence; identical to SEQ ID NO: 108405
  derived and/or modified sequence opt2 from neuraminidase__InfluenzaA__ACS34971

SEQ ID NO: 108500 - RNA, 1410 nt, Artificial Sequence; identical to SEQ ID NO: 108250
  derived and/or modified sequence opt2 from neuraminidase__InfluenzaA__ACS34972

SEQ ID NO: 108501 - RNA, 1410 nt, Artificial Sequence; identical to SEQ ID NO: 108250
  derived and/or modified sequence opt2 from neuraminidase__InfluenzaA__ACS50081

SEQ ID NO: 108502 - RNA, 1410 nt, Artificial Sequence; identical to SEQ ID NO: 108250
  derived and/or modified sequence opt2 from neuraminidase__InfluenzaA__ACS50087

SEQ ID NO: 108503 - RNA, 1410 nt, Artificial Sequence; identical to SEQ ID NO: 108250
  derived and/or modified sequence opt2 from neuraminidase__InfluenzaA__ACS50094

SEQ ID NO: 108504 - RNA, 1410 nt, Artificial Sequence; identical to SEQ ID NO: 108240
  derived and/or modified sequence opt2 from neuraminidase__InfluenzaA__ACS54264

SEQ ID NO: 108505 - RNA, 1410 nt, Artificial Sequence; identical to SEQ ID NO: 108405
  derived and/or modified sequence opt2 from neuraminidase__InfluenzaA__ACS54265

SEQ ID NO: 108506 - RNA, 1410 nt, Artificial Sequence; identical to SEQ ID NO: 108250
  derived and/or modified sequence opt2 from neuraminidase__InfluenzaA__ACS54266

SEQ ID NO: 108507 - RNA, 1410 nt, Artificial Sequence; identical to SEQ ID NO: 108250
  derived and/or modified sequence opt2 from neuraminidase__InfluenzaA__ACS54267

SEQ ID NO: 108508 - RNA, 1410 nt, Artificial Sequence; identical to SEQ ID NO: 108250
  derived and/or modified sequence opt2 from neuraminidase__InfluenzaA__ACS54268

SEQ ID NO: 108509 - RNA, 1410 nt, Artificial Sequence; identical to SEQ ID NO: 108250
  derived and/or modified sequence opt2 from neuraminidase__InfluenzaA__ACS54303

SEQ ID NO: 108510 - RNA, 1410 nt, Artificial Sequence; identical to SEQ ID NO: 108250
  derived and/or modified sequence opt2 from neuraminidase__InfluenzaA__ACS68823

SEQ ID NO: 108511 - RNA, 1410 nt, Artificial Sequence; identical to SEQ ID NO: 108250
  derived and/or modified sequence opt2 from neuraminidase__InfluenzaA__ACS75824

SEQ ID NO: 108512 - RNA, 1410 nt, Artificial Sequence; identical to SEQ ID NO: 108250
  derived and/or modified sequence opt2 from neuraminidase__InfluenzaA__ACS77929

SEQ ID NO: 108513 - RNA, 1410 nt, Artificial Sequence; identical to SEQ ID NO: 108250
  derived and/or modified sequence opt2 from neuraminidase__InfluenzaA__ACS77939

SEQ ID NO: 108514 - RNA, 1410 nt, Artificial Sequence; identical to SEQ ID NO: 108240
  derived and/or modified sequence opt2 from neuraminidase__InfluenzaA__ACS77949

SEQ ID NO: 108515 - RNA, 1410 nt, Artificial Sequence; identical to SEQ ID NO: 108250
  derived and/or modified sequence opt2 from neuraminidase__InfluenzaA__ACS77959

SEQ ID NO: 108516 - RNA, 1410 nt, Artificial Sequence; identical to SEQ ID NO: 108250
  derived and/or modified sequence opt2 from neuraminidase__InfluenzaA__ACS77969

SEQ ID NO: 108517 - RNA, 1410 nt, Artificial Sequence; identical to SEQ ID NO: 108250
  derived and/or modified sequence opt2 from neuraminidase__InfluenzaA__ACS77979

SEQ ID NO: 108518 - RNA, 1410 nt, Artificial Sequence; identical to SEQ ID NO: 108250
  derived and/or modified sequence opt2 from neuraminidase__InfluenzaA__ACS77989

SEQ ID NO: 108519 - RNA, 1410 nt, Artificial Sequence; identical to SEQ ID NO: 108250
  derived and/or modified sequence opt2 from neuraminidase__InfluenzaA__ACS77999

SEQ ID NO: 108520 - RNA, 1410 nt, Artificial Sequence; identical to SEQ ID NO: 108250
  derived and/or modified sequence opt2 from neuraminidase__InfluenzaA__ACS78009

SEQ ID NO: 108521 - RNA, 1410 nt, Artificial Sequence; identical to SEQ ID NO: 108250
  derived and/or modified sequence opt2 from neuraminidase__InfluenzaA__ACS78019

SEQ ID NO: 108522 - RNA, 1410 nt, Artificial Sequence; identical to SEQ ID NO: 108250
  derived and/or modified sequence opt2 from neuraminidase__InfluenzaA__ACS78039

SEQ ID NO: 108523 - RNA, 1410 nt, Artificial Sequence; identical to SEQ ID NO: 108250
  derived and/or modified sequence opt2 from neuraminidase__InfluenzaA__ACS78049

SEQ ID NO: 108524 - RNA, 1410 nt, Artificial Sequence; identical to SEQ ID NO: 108250
  derived and/or modified sequence opt2 from neuraminidase__InfluenzaA__ACS88274

SEQ ID NO: 108525 - RNA, 1410 nt, Artificial Sequence; identical to SEQ ID NO: 108250
  derived and/or modified sequence opt2 from neuraminidase__InfluenzaA__ACS88275

SEQ ID NO: 108526 - RNA, 1410 nt, Artificial Sequence; identical to SEQ ID NO: 108240
  derived and/or modified sequence opt2 from neuraminidase__InfluenzaA__ACS92572

SEQ ID NO: 108527 - RNA, 1410 nt, Artificial Sequence; identical to SEQ ID NO: 108240
  derived and/or modified sequence opt2 from neuraminidase__InfluenzaA__ACS92582

SEQ ID NO: 108528 - RNA, 1410 nt, Artificial Sequence; identical to SEQ ID NO: 108250
  derived and/or modified sequence opt2 from neuraminidase__InfluenzaA__ACS92592

SEQ ID NO: 108529 - RNA, 1410 nt, Artificial Sequence; identical to SEQ ID NO: 108250
  derived and/or modified sequence opt2 from neuraminidase__InfluenzaA__ACS92603

SEQ ID NO: 108530 - RNA, 1410 nt, Artificial Sequence; identical to SEQ ID NO: 108240
  derived and/or modified sequence opt2 from neuraminidase__InfluenzaA__ACS92614

SEQ ID NO: 108531 - RNA, 1410 nt, Artificial Sequence; identical to SEQ ID NO: 108250
  derived and/or modified sequence opt2 from neuraminidase__InfluenzaA__ACT09115

SEQ ID NO: 108532 - RNA, 1410 nt, Artificial Sequence; identical to SEQ ID NO: 108250
  derived and/or modified sequence opt2 from neuraminidase__InfluenzaA__ACT10309

SEQ ID NO: 108533 - RNA, 1410 nt, Artificial Sequence; identical to SEQ ID NO: 108250
  derived and/or modified sequence opt2 from neuraminidase__InfluenzaA__ACT10315

SEQ ID NO: 108534 - RNA, 1410 nt, Artificial Sequence; identical to SEQ ID NO: 108240
  derived and/or modified sequence opt2 from neuraminidase__InfluenzaA__ACT11059

SEQ ID NO: 108535 - RNA, 1350 nt, Artificial Sequence
  derived and/or modified sequence opt2 from neuraminidase__InfluenzaA__ACT15313
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108536 - RNA, 1350 nt, Artificial Sequence
  derived and/or modified sequence opt2 from neuraminidase__InfluenzaA__ACT15315
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucaugcgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108537 - RNA, 1350 nt, Artificial Sequence; identical to SEQ ID NO: 108535
  derived and/or modified sequence opt2 from neuraminidase__InfluenzaA__ACT15319

SEQ ID NO: 108538 - RNA, 1350 nt, Artificial Sequence
  derived and/or modified sequence opt2 from neuraminidase__InfluenzaA__ACT15321
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagcgcgccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108539 - RNA, 1350 nt, Artificial Sequence; identical to SEQ ID NO: 108535
  derived and/or modified sequence opt2 from neuraminidase__InfluenzaA__ACT15323

SEQ ID NO: 108540 - RNA, 1350 nt, Artificial Sequence; identical to SEQ ID NO: 108535
  derived and/or modified sequence opt2 from neuraminidase__InfluenzaA__ACT15325

SEQ ID NO: 108541 - RNA, 1350 nt, Artificial Sequence
  derived and/or modified sequence opt2 from neuraminidase__InfluenzaA__ACT15327
augaaccccaaccagaagaucaucaccaucggcuccaucugcauggucaucggcaucgucucccucaugcuccagaucggcaacaugaucuccaucugggucucccacuccauccagaccggcaaccgcugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguacaagaucggcuacaucugcuccggcaucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108542 - RNA, 1350 nt, Artificial Sequence
  derived and/or modified sequence opt2 from neuraminidase__InfluenzaA__ACT15331
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108543 - RNA, 1350 nt, Artificial Sequence
  derived and/or modified sequence opt2 from neuraminidase__InfluenzaA__ACT15333
augaaccccaaccagaagaucaucaccaucggcuccaucugcauggucaucggcaucgucucccucaugcuccagaucggcaacaugaucuccaucugggucucccacuccauccagaccggcaaccagugccagggcgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucgucuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccggcaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108544 - RNA, 1350 nt, Artificial Sequence
  derived and/or modified sequence opt2 from neuraminidase__InfluenzaA__ACT15335
augaaccccaaccagaagaucaucaccaucggcuccaucugcauggucaucggcaucgucucccucaugcuccagaucggcaacaugaucuccaucugggucucccacuccauccagaccggcaaccgcugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguacaagaucggcuacaucugcuccggcaucuucggcgacaacccccgccccaacgacggcaccggcuccugcggccccguccuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108545 - RNA, 1350 nt, Artificial Sequence
  derived and/or modified sequence opt2 from neuraminidase__InfluenzaA__ACT15337
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccgucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108546 - RNA, 1350 nt, Artificial Sequence; identical to SEQ ID NO: 108535
  derived and/or modified sequence opt2 from neuraminidase__InfluenzaA__ACT15341

SEQ ID NO: 108547 - RNA, 1350 nt, Artificial Sequence
  derived and/or modified sequence opt2 from neuraminidase__InfluenzaA__ACT15344
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcuccaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108548 - RNA, 1350 nt, Artificial Sequence
  derived and/or modified sequence opt2 from neuraminidase__InfluenzaA__ACT15346
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacaacauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108549 - RNA, 1350 nt, Artificial Sequence
  derived and/or modified sequence opt2 from neuraminidase__InfluenzaA__ACT15348
augaaccccaaccagaagaucaucaccaucggcuccaucugcauggucaucggcaccgucucccucaugcuccagaucggcaacaugaucuccaucugggucucccacuccauccagaccggcaaccagugccagggcgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucgucuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccggcaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108550 - RNA, 1350 nt, Artificial Sequence
  derived and/or modified sequence opt2 from neuraminidase__InfluenzaA__ACT15350
augaaccccaaccagaagaucaucaccaucggcuccaucugcauggucaucggcaucgucucccucaugcuccagaucggcaacaugaucuccaucugggucucccacuccauccagaccggcaaccgcugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguacaagaucggcuacaucugcuccggcaucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggagcgcaccaucuggaccuccggcuccuccaucuccuucugcggcgucaacggcgacaccgucuccugguccuggcccgacggcgccgagcuccccuucaccaucgacaaguga

SEQ ID NO: 108551 - RNA, 1350 nt, Artificial Sequence
  derived and/or modified sequence opt2 from neuraminidase__InfluenzaA__ACT15352
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucgucuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccggcaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108552 - RNA, 1350 nt, Artificial Sequence
  derived and/or modified sequence opt2 from neuraminidase__InfluenzaA__ACT15354
augaaccccucccagaagaucaucaccaucggcuccaucugcauggucaucggcaucgucucccucaugcuccagaucggcaacaugaucuccaucuggaucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108553 - RNA, 1350 nt, Artificial Sequence
  derived and/or modified sequence opt2 from neuraminidase__InfluenzaA__ACT15356
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuucuccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccggcaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 108554 - RNA, 1350 nt, Artificial Sequence
  derived and/or modified sequence opt2 from neuraminidase__InfluenzaA__ACT15358
augaaccccaaccagaagaucaucaccaucggcuccaucugcauggucaucggcaucgucucccucaugcuccagaucggcaacaugaucuccaucugggucucccacuccauccagaccggcaaccgcugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccacggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccuggaucuccuucaaccagaaccucgaguacaagaucggcuacaucugcuccggcaucuucggcgacaacccccgccccaacgacggcaccggcuccugcggccccguccuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 108555 - RNA, 1410 nt, Artificial Sequence; identical to SEQ ID NO: 105839
  derived and/or modified sequence opt2 from neuraminidase__InfluenzaA__ACT21515

SEQ ID NO: 108556 - RNA, 1410 nt, Artificial Sequence
  derived and/or modified sequence opt2 from neuraminidase__InfluenzaA__ACT21516
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgccuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcgucgccugguccuccuccuccugccacgacggcaaggccuggcuccacgucugcgucaccggcgacgagaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 108557 - RNA, 1410 nt, Artificial Sequence
  derived and/or modified sequence opt2 from neuraminidase__InfluenzaA__ACT21517
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccgagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccucgucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgccggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108558 - RNA, 1410 nt, Artificial Sequence; identical to SEQ ID NO: 108250
  derived and/or modified sequence opt2 from neuraminidase__InfluenzaA__ACT21574

SEQ ID NO: 108559 - RNA, 1410 nt, Artificial Sequence; identical to SEQ ID NO: 108250
  derived and/or modified sequence opt2 from neuraminidase__InfluenzaA__ACT21585

SEQ ID NO: 108560 - RNA, 1410 nt, Artificial Sequence; identical to SEQ ID NO: 108250
  derived and/or modified sequence opt2 from neuraminidase__InfluenzaA__ACT22011

SEQ ID NO: 108561 - RNA, 1410 nt, Artificial Sequence; identical to SEQ ID NO: 108250
  derived and/or modified sequence opt2 from neuraminidase__InfluenzaA__ACT22012

SEQ ID NO: 108562 - RNA, 1410 nt, Artificial Sequence; identical to SEQ ID NO: 108250
  derived and/or modified sequence opt2 from neuraminidase__InfluenzaA__ACT22013

SEQ ID NO: 108563 - RNA, 1410 nt, Artificial Sequence; identical to SEQ ID NO: 108250
  derived and/or modified sequence opt2 from neuraminidase__InfluenzaA__ACT22014

SEQ ID NO: 108564 - RNA, 1410 nt, Artificial Sequence; identical to SEQ ID NO: 108240
  derived and/or modified sequence opt2 from neuraminidase__InfluenzaA__ACT22015

SEQ ID NO: 108565 - RNA, 1410 nt, Artificial Sequence
  derived and/or modified sequence opt2 from neuraminidase__InfluenzaA__ACT22016
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108566 - RNA, 1410 nt, Artificial Sequence; identical to SEQ ID NO: 108250
  derived and/or modified sequence opt2 from neuraminidase__InfluenzaA__ACT22017

SEQ ID NO: 108567 - RNA, 1410 nt, Artificial Sequence; identical to SEQ ID NO: 108250
  derived and/or modified sequence opt2 from neuraminidase__InfluenzaA__ACT22018

SEQ ID NO: 108568 - RNA, 1410 nt, Artificial Sequence; identical to SEQ ID NO: 108240
  derived and/or modified sequence opt2 from neuraminidase__InfluenzaA__ACT22506

SEQ ID NO: 108569 - RNA, 1410 nt, Artificial Sequence; identical to SEQ ID NO: 108250
  derived and/or modified sequence opt2 from neuraminidase__InfluenzaA__ACT22511

SEQ ID NO: 108570 - RNA, 1410 nt, Artificial Sequence; identical to SEQ ID NO: 108250
  derived and/or modified sequence opt2 from neuraminidase__InfluenzaA__ACT33121

SEQ ID NO: 108571 - RNA, 1410 nt, Artificial Sequence; identical to SEQ ID NO: 108250
  derived and/or modified sequence opt2 from neuraminidase__InfluenzaA__ACT33124

SEQ ID NO: 108572 - RNA, 1410 nt, Artificial Sequence; identical to SEQ ID NO: 108250
  derived and/or modified sequence opt2 from neuraminidase__InfluenzaA__ACT33126

SEQ ID NO: 108573 - RNA, 1410 nt, Artificial Sequence; identical to SEQ ID NO: 108240
  derived and/or modified sequence opt2 from neuraminidase__InfluenzaA__ACT35526

SEQ ID NO: 108574 - RNA, 1410 nt, Artificial Sequence; identical to SEQ ID NO: 108250
  derived and/or modified sequence opt2 from neuraminidase__InfluenzaA__ACT36507

SEQ ID NO: 108575 - RNA, 1410 nt, Artificial Sequence; identical to SEQ ID NO: 108250
  derived and/or modified sequence opt2 from neuraminidase__InfluenzaA__ACT36672

SEQ ID NO: 108576 - RNA, 1410 nt, Artificial Sequence; identical to SEQ ID NO: 108250
  derived and/or modified sequence opt2 from neuraminidase__InfluenzaA__ACT36673

SEQ ID NO: 108577 - RNA, 1410 nt, Artificial Sequence; identical to SEQ ID NO: 108250
  derived and/or modified sequence opt2 from neuraminidase__InfluenzaA__ACT36674

SEQ ID NO: 108578 - RNA, 1410 nt, Artificial Sequence; identical to SEQ ID NO: 108250
  derived and/or modified sequence opt2 from neuraminidase__InfluenzaA__ACT36675

SEQ ID NO: 108579 - RNA, 1410 nt, Artificial Sequence; identical to SEQ ID NO: 108250
  derived and/or modified sequence opt2 from neuraminidase__InfluenzaA__ACT36677

SEQ ID NO: 108580 - RNA, 1410 nt, Artificial Sequence
  derived and/or modified sequence opt2 from neuraminidase__InfluenzaA__ACT36678
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgcccgccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108581 - RNA, 1410 nt, Artificial Sequence; identical to SEQ ID NO: 108240
  derived and/or modified sequence opt2 from neuraminidase__InfluenzaA__ACT36679

SEQ ID NO: 108582 - RNA, 1410 nt, Artificial Sequence; identical to SEQ ID NO: 108250
  derived and/or modified sequence opt2 from neuraminidase__InfluenzaA__ACT36680

SEQ ID NO: 108583 - RNA, 1410 nt, Artificial Sequence; identical to SEQ ID NO: 108240
  derived and/or modified sequence opt2 from neuraminidase__InfluenzaA__ACT36682

SEQ ID NO: 108584 - RNA, 1410 nt, Artificial Sequence; identical to SEQ ID NO: 108240
  derived and/or modified sequence opt2 from neuraminidase__InfluenzaA__ACT36683

SEQ ID NO: 108585 - RNA, 1410 nt, Artificial Sequence; identical to SEQ ID NO: 108250
  derived and/or modified sequence opt2 from neuraminidase__InfluenzaA__ACT36684

SEQ ID NO: 108586 - RNA, 1410 nt, Artificial Sequence; identical to SEQ ID NO: 108240
  derived and/or modified sequence opt2 from neuraminidase__InfluenzaA__ACT36685

SEQ ID NO: 108587 - RNA, 1410 nt, Artificial Sequence; identical to SEQ ID NO: 108240
  derived and/or modified sequence opt2 from neuraminidase__InfluenzaA__ACT36686

SEQ ID NO: 108588 - RNA, 1410 nt, Artificial Sequence; identical to SEQ ID NO: 108240
  derived and/or modified sequence opt2 from neuraminidase__InfluenzaA__ACT36687

SEQ ID NO: 108589 - RNA, 1410 nt, Artificial Sequence
  derived and/or modified sequence opt2 from neuraminidase__InfluenzaA__ACT36688
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuacaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108590 - RNA, 1410 nt, Artificial Sequence; identical to SEQ ID NO: 108240
  derived and/or modified sequence opt2 from neuraminidase__InfluenzaA__ACT36689

SEQ ID NO: 108591 - RNA, 1410 nt, Artificial Sequence; identical to SEQ ID NO: 108280
  derived and/or modified sequence opt2 from neuraminidase__InfluenzaA__ACT36690

SEQ ID NO: 108592 - RNA, 1410 nt, Artificial Sequence; identical to SEQ ID NO: 108240
  derived and/or modified sequence opt2 from neuraminidase__InfluenzaA__ACT36691

SEQ ID NO: 108593 - RNA, 1410 nt, Artificial Sequence; identical to SEQ ID NO: 108280
  derived and/or modified sequence opt2 from neuraminidase__InfluenzaA__ACT36693

SEQ ID NO: 108594 - RNA, 1410 nt, Artificial Sequence; identical to SEQ ID NO: 108250
  derived and/or modified sequence opt2 from neuraminidase__InfluenzaA__ACT36694

SEQ ID NO: 108595 - RNA, 1410 nt, Artificial Sequence; identical to SEQ ID NO: 108250
  derived and/or modified sequence opt2 from neuraminidase__InfluenzaA__ACT36695

SEQ ID NO: 108596 - RNA, 1410 nt, Artificial Sequence; identical to SEQ ID NO: 108250
  derived and/or modified sequence opt2 from neuraminidase__InfluenzaA__ACT52684

SEQ ID NO: 108597 - RNA, 1410 nt, Artificial Sequence; identical to SEQ ID NO: 108240
  derived and/or modified sequence opt2 from neuraminidase__InfluenzaA__ACT54608

SEQ ID NO: 108598 - RNA, 1410 nt, Artificial Sequence
  derived and/or modified sequence opt2 from neuraminidase__InfluenzaA__ACT66157
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagauccuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108599 - RNA, 1410 nt, Artificial Sequence; identical to SEQ ID NO: 108250
  derived and/or modified sequence opt2 from neuraminidase__InfluenzaA__ACT67117

SEQ ID NO: 108600 - RNA, 1410 nt, Artificial Sequence; identical to SEQ ID NO: 108240
  derived and/or modified sequence opt2 from neuraminidase__InfluenzaA__ACT67121

SEQ ID NO: 108601 - RNA, 1410 nt, Artificial Sequence; identical to SEQ ID NO: 108250
  derived and/or modified sequence opt2 from neuraminidase__InfluenzaA__ACT67240

SEQ ID NO: 108602 - RNA, 1410 nt, Artificial Sequence; identical to SEQ ID NO: 108250
  derived and/or modified sequence opt2 from neuraminidase__InfluenzaA__ACT67241

SEQ ID NO: 108603 - RNA, 1410 nt, Artificial Sequence; identical to SEQ ID NO: 108250
  derived and/or modified sequence opt2 from neuraminidase__InfluenzaA__ACT67243

SEQ ID NO: 108604 - RNA, 1410 nt, Artificial Sequence
  derived and/or modified sequence opt2 from neuraminidase__InfluenzaA__ACT67256
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108605 - RNA, 1410 nt, Artificial Sequence
  derived and/or modified sequence opt2 from neuraminidase__InfluenzaA__ACT68161
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaaggccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108606 - RNA, 1410 nt, Artificial Sequence; identical to SEQ ID NO: 108240
  derived and/or modified sequence opt2 from neuraminidase__InfluenzaA__ACT68162

SEQ ID NO: 108607 - RNA, 1410 nt, Artificial Sequence; identical to SEQ ID NO: 108240
  derived and/or modified sequence opt2 from neuraminidase__InfluenzaA__ACT68163

SEQ ID NO: 108608 - RNA, 1410 nt, Artificial Sequence; identical to SEQ ID NO: 108240
  derived and/or modified sequence opt2 from neuraminidase__InfluenzaA__ACT68164

SEQ ID NO: 108609 - RNA, 1410 nt, Artificial Sequence; identical to SEQ ID NO: 108250
  derived and/or modified sequence opt2 from neuraminidase__InfluenzaA__ACT68166

SEQ ID NO: 108610 - RNA, 1410 nt, Artificial Sequence; identical to SEQ ID NO: 108250
  derived and/or modified sequence opt2 from neuraminidase__InfluenzaA__ACT68167

SEQ ID NO: 108611 - RNA, 1410 nt, Artificial Sequence; identical to SEQ ID NO: 108280
  derived and/or modified sequence opt2 from neuraminidase__InfluenzaA__ACT68168

SEQ ID NO: 108612 - RNA, 1410 nt, Artificial Sequence
  derived and/or modified sequence opt2 from neuraminidase__InfluenzaA__ACT68169
augaaccccaaccagaagaucaucaccaucggcuccgucugcaugaccaucggcauggccaaccucauccuccagaucggcaacaucaucuccaucuggaucucccacuccauccagcucggcgaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacgagaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucuccgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108613 - RNA, 1410 nt, Artificial Sequence; identical to SEQ ID NO: 108240
  derived and/or modified sequence opt2 from neuraminidase__InfluenzaA__ACT68171

SEQ ID NO: 108614 - RNA, 1410 nt, Artificial Sequence; identical to SEQ ID NO: 108240
  derived and/or modified sequence opt2 from neuraminidase__InfluenzaA__ACT68172

SEQ ID NO: 108615 - RNA, 1410 nt, Artificial Sequence; identical to SEQ ID NO: 108250
  derived and/or modified sequence opt2 from neuraminidase__InfluenzaA__ACT68173

SEQ ID NO: 108616 - RNA, 1410 nt, Artificial Sequence; identical to SEQ ID NO: 108250
  derived and/or modified sequence opt2 from neuraminidase__InfluenzaA__ACT68174

SEQ ID NO: 108617 - RNA, 1410 nt, Artificial Sequence
  derived and/or modified sequence opt2 from neuraminidase__InfluenzaA__ACT68175
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108618 - RNA, 1410 nt, Artificial Sequence; identical to SEQ ID NO: 108250
  derived and/or modified sequence opt2 from neuraminidase__InfluenzaA__ACT68176

SEQ ID NO: 108619 - RNA, 1410 nt, Artificial Sequence; identical to SEQ ID NO: 108250
  derived and/or modified sequence opt2 from neuraminidase__InfluenzaA__ACT68177

SEQ ID NO: 108620 - RNA, 1410 nt, Artificial Sequence; identical to SEQ ID NO: 108250
  derived and/or modified sequence opt2 from neuraminidase__InfluenzaA__ACT68178

SEQ ID NO: 108621 - RNA, 1410 nt, Artificial Sequence; identical to SEQ ID NO: 108617
  derived and/or modified sequence opt2 from neuraminidase__InfluenzaA__ACT68179

SEQ ID NO: 108622 - RNA, 1410 nt, Artificial Sequence; identical to SEQ ID NO: 108250
  derived and/or modified sequence opt2 from neuraminidase__InfluenzaA__ACT68180

SEQ ID NO: 108623 - RNA, 1410 nt, Artificial Sequence; identical to SEQ ID NO: 108280
  derived and/or modified sequence opt2 from neuraminidase__InfluenzaA__ACT79145

SEQ ID NO: 108624 - RNA, 1410 nt, Artificial Sequence
  derived and/or modified sequence opt2 from neuraminidase__InfluenzaA__ACT79155
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucggcggcugggccaucuacuccaaggacaacuccguccgcaucggcuccaagggcgacgucuucgucauccgcgagcccuucaucuccugcucccuccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108625 - RNA, 1410 nt, Artificial Sequence; identical to SEQ ID NO: 108240
  derived and/or modified sequence opt2 from neuraminidase__InfluenzaA__ACT79165

SEQ ID NO: 108626 - RNA, 1410 nt, Artificial Sequence; identical to SEQ ID NO: 108240
  derived and/or modified sequence opt2 from neuraminidase__InfluenzaA__ACT79175

SEQ ID NO: 108627 - RNA, 1410 nt, Artificial Sequence; identical to SEQ ID NO: 108250
  derived and/or modified sequence opt2 from neuraminidase__InfluenzaA__ACT79185

SEQ ID NO: 108628 - RNA, 1410 nt, Artificial Sequence; identical to SEQ ID NO: 108250
  derived and/or modified sequence opt2 from neuraminidase__InfluenzaA__ACT79622

SEQ ID NO: 108629 - RNA, 1410 nt, Artificial Sequence; identical to SEQ ID NO: 108617
  derived and/or modified sequence opt2 from neuraminidase__InfluenzaA__ACT79630

SEQ ID NO: 108630 - RNA, 1410 nt, Artificial Sequence; identical to SEQ ID NO: 108250
  derived and/or modified sequence opt2 from neuraminidase__InfluenzaA__ACT83798

SEQ ID NO: 108631 - RNA, 1410 nt, Artificial Sequence; identical to SEQ ID NO: 108250
  derived and/or modified sequence opt2 from neuraminidase__InfluenzaA__ACT83808

SEQ ID NO: 108632 - RNA, 1410 nt, Artificial Sequence; identical to SEQ ID NO: 108250
  derived and/or modified sequence opt2 from neuraminidase__InfluenzaA__ACT83818

SEQ ID NO: 108633 - RNA, 1410 nt, Artificial Sequence; identical to SEQ ID NO: 108250
  derived and/or modified sequence opt2 from neuraminidase__InfluenzaA__ACT83828

SEQ ID NO: 108634 - RNA, 1410 nt, Artificial Sequence; identical to SEQ ID NO: 108250
  derived and/or modified sequence opt2 from neuraminidase__InfluenzaA__ACT83838

SEQ ID NO: 108635 - RNA, 1410 nt, Artificial Sequence; identical to SEQ ID NO: 108240
  derived and/or modified sequence opt2 from neuraminidase__InfluenzaA__ACT83848

SEQ ID NO: 108636 - RNA, 1410 nt, Artificial Sequence; identical to SEQ ID NO: 108240
  derived and/or modified sequence opt2 from neuraminidase__InfluenzaA__ACT83858

SEQ ID NO: 108637 - RNA, 1410 nt, Artificial Sequence; identical to SEQ ID NO: 108250
  derived and/or modified sequence opt2 from neuraminidase__InfluenzaA__ACT83868

SEQ ID NO: 108638 - RNA, 1410 nt, Artificial Sequence; identical to SEQ ID NO: 108250
  derived and/or modified sequence opt2 from neuraminidase__InfluenzaA__ACT83878

SEQ ID NO: 108639 - RNA, 1410 nt, Artificial Sequence; identical to SEQ ID NO: 108250
  derived and/or modified sequence opt2 from neuraminidase__InfluenzaA__ACT86002

SEQ ID NO: 108640 - RNA, 1410 nt, Artificial Sequence; identical to SEQ ID NO: 108250
  derived and/or modified sequence opt2 from neuraminidase__InfluenzaA__ACT86012

SEQ ID NO: 108641 - RNA, 1410 nt, Artificial Sequence; identical to SEQ ID NO: 108250
  derived and/or modified sequence opt2 from neuraminidase__InfluenzaA__ACT86022

SEQ ID NO: 108642 - RNA, 1410 nt, Artificial Sequence; identical to SEQ ID NO: 108240
  derived and/or modified sequence opt2 from neuraminidase__InfluenzaA__ACT86032

SEQ ID NO: 108643 - RNA, 1410 nt, Artificial Sequence; identical to SEQ ID NO: 108250
  derived and/or modified sequence opt2 from neuraminidase__InfluenzaA__ACT86042

SEQ ID NO: 108644 - RNA, 1410 nt, Artificial Sequence; identical to SEQ ID NO: 108250
  derived and/or modified sequence opt2 from neuraminidase__InfluenzaA__ACT86052

SEQ ID NO: 108645 - RNA, 1410 nt, Artificial Sequence; identical to SEQ ID NO: 108250
  derived and/or modified sequence opt2 from neuraminidase__InfluenzaA__ACT86062

SEQ ID NO: 108646 - RNA, 1410 nt, Artificial Sequence; identical to SEQ ID NO: 108250
  derived and/or modified sequence opt2 from neuraminidase__InfluenzaA__ACT86072

SEQ ID NO: 108647 - RNA, 1410 nt, Artificial Sequence; identical to SEQ ID NO: 108250
  derived and/or modified sequence opt2 from neuraminidase__InfluenzaA__ACT86082

SEQ ID NO: 108648 - RNA, 1410 nt, Artificial Sequence; identical to SEQ ID NO: 108250
  derived and/or modified sequence opt2 from neuraminidase__InfluenzaA__ACT86092

SEQ ID NO: 108649 - RNA, 1410 nt, Artificial Sequence; identical to SEQ ID NO: 108250
  derived and/or modified sequence opt2 from neuraminidase__InfluenzaA__ACT86102

SEQ ID NO: 108650 - RNA, 1410 nt, Artificial Sequence; identical to SEQ ID NO: 108250
  derived and/or modified sequence opt2 from neuraminidase__InfluenzaA__ACT86112

SEQ ID NO: 108651 - RNA, 1410 nt, Artificial Sequence; identical to SEQ ID NO: 108250
  derived and/or modified sequence opt2 from neuraminidase__InfluenzaA__ACT86122

SEQ ID NO: 108652 - RNA, 1410 nt, Artificial Sequence; identical to SEQ ID NO: 108250
  derived and/or modified sequence opt2 from neuraminidase__InfluenzaA__ACT86132

SEQ ID NO: 108653 - RNA, 1410 nt, Artificial Sequence; identical to SEQ ID NO: 108250
  derived and/or modified sequence opt2 from neuraminidase__InfluenzaA__ACT86142

SEQ ID NO: 108654 - RNA, 1410 nt, Artificial Sequence; identical to SEQ ID NO: 108240
  derived and/or modified sequence opt2 from neuraminidase__InfluenzaA__ACT97323

SEQ ID NO: 108655 - RNA, 1410 nt, Artificial Sequence; identical to SEQ ID NO: 108250
  derived and/or modified sequence opt2 from neuraminidase__InfluenzaA__ACU00934

SEQ ID NO: 108656 - RNA, 1410 nt, Artificial Sequence; identical to SEQ ID NO: 108250
  derived and/or modified sequence opt2 from neuraminidase__InfluenzaA__ACU00944

SEQ ID NO: 108657 - RNA, 1410 nt, Artificial Sequence; identical to SEQ ID NO: 108604
  derived and/or modified sequence opt2 from neuraminidase__InfluenzaA__ACU00954

SEQ ID NO: 108658 - RNA, 1410 nt, Artificial Sequence
  derived and/or modified sequence opt2 from neuraminidase__InfluenzaA__ACU12497
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagcgcgagaucugccccaagcucgucgaguaccgcaacugguccaagccccagugccgcgucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 108659 - RNA, 1413 nt, Artificial Sequence; identical to SEQ ID NO: 108144
  derived and/or modified sequence opt2 from neuraminidase__InfluenzaA__ACU12508

SEQ ID NO: 108660 - RNA, 1410 nt, Artificial Sequence
  derived and/or modified sequence opt2 from neuraminidase__InfluenzaA__ACU12519
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacgagaacgccaccgccuccuucaucuacaacggccgccucgucgacuccgucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 108661 - RNA, 1410 nt, Artificial Sequence
  derived and/or modified sequence opt2 from neuraminidase__InfluenzaA__ACU12530
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcaacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108662 - RNA, 1410 nt, Artificial Sequence
  derived and/or modified sequence opt2 from neuraminidase__InfluenzaA__ACU12541
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaaguggcagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108663 - RNA, 1410 nt, Artificial Sequence
  derived and/or modified sequence opt2 from neuraminidase__InfluenzaA__ACU12552
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccggcuacgucugcuccggccucgucggcgacaccccccgcaagaacgacuccuccuccuccucccacugcuccgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108664 - RNA, 1413 nt, Artificial Sequence
  derived and/or modified sequence opt2 from neuraminidase__InfluenzaA__ACU12574
augaaccccaaccagaagaucaucaccaucggcuccaucuccaucgccaucggcaucaucaaccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108665 - RNA, 1413 nt, Artificial Sequence; identical to SEQ ID NO: 108144
  derived and/or modified sequence opt2 from neuraminidase__InfluenzaA__ACU12585

SEQ ID NO: 108666 - RNA, 1413 nt, Artificial Sequence
  derived and/or modified sequence opt2 from neuraminidase__InfluenzaA__ACU12596
augaaccccaaccagaagaucaucaccaucggcuccaucuccaucgccaucggcaucaucucccucaugcuccagaucggcuccaucaucuccaucugggccucccacuccauccgcaccggcucccagaacaacaccggcaucugcaaccagcgcaucaucaccuacgagaacuccaccugggucaaccacaccuacgucaacaucaacaacaccaacgucgucgccggcgaggacaagaaguccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108667 - RNA, 1410 nt, Artificial Sequence; identical to SEQ ID NO: 108250
  derived and/or modified sequence opt2 from neuraminidase__InfluenzaA__ACU13077

SEQ ID NO: 108668 - RNA, 1410 nt, Artificial Sequence; identical to SEQ ID NO: 108250
  derived and/or modified sequence opt2 from neuraminidase__InfluenzaA__ACU13078

SEQ ID NO: 108669 - RNA, 1410 nt, Artificial Sequence; identical to SEQ ID NO: 108250
  derived and/or modified sequence opt2 from neuraminidase__InfluenzaA__ACU13079

SEQ ID NO: 108670 - RNA, 1410 nt, Artificial Sequence; identical to SEQ ID NO: 108250
  derived and/or modified sequence opt2 from neuraminidase__InfluenzaA__ACU13080

SEQ ID NO: 108671 - RNA, 1410 nt, Artificial Sequence; identical to SEQ ID NO: 108240
  derived and/or modified sequence opt2 from neuraminidase__InfluenzaA__ACU13081

SEQ ID NO: 108672 - RNA, 1410 nt, Artificial Sequence; identical to SEQ ID NO: 108250
  derived and/or modified sequence opt2 from neuraminidase__InfluenzaA__ACU13082

SEQ ID NO: 108673 - RNA, 1410 nt, Artificial Sequence; identical to SEQ ID NO: 108250
  derived and/or modified sequence opt2 from neuraminidase__InfluenzaA__ACU13083

SEQ ID NO: 108674 - RNA, 1410 nt, Artificial Sequence
  derived and/or modified sequence opt2 from neuraminidase__InfluenzaA__ACU13084
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108675 - RNA, 1410 nt, Artificial Sequence; identical to SEQ ID NO: 108250
  derived and/or modified sequence opt2 from neuraminidase__InfluenzaA__ACU16799

SEQ ID NO: 108676 - RNA, 1410 nt, Artificial Sequence; identical to SEQ ID NO: 108250
  derived and/or modified sequence opt2 from neuraminidase__InfluenzaA__ACU16861

SEQ ID NO: 108677 - RNA, 1410 nt, Artificial Sequence; identical to SEQ ID NO: 108250
  derived and/or modified sequence opt2 from neuraminidase__InfluenzaA__ACU16934

SEQ ID NO: 108678 - RNA, 1410 nt, Artificial Sequence; identical to SEQ ID NO: 108250
  derived and/or modified sequence opt2 from neuraminidase__InfluenzaA__ACU16997

SEQ ID NO: 108679 - RNA, 1410 nt, Artificial Sequence; identical to SEQ ID NO: 108250
  derived and/or modified sequence opt2 from neuraminidase__InfluenzaA__ACU17130

SEQ ID NO: 108680 - RNA, 1410 nt, Artificial Sequence; identical to SEQ ID NO: 108250
  derived and/or modified sequence opt2 from neuraminidase__InfluenzaA__ACU17191

SEQ ID NO: 108681 - RNA, 1410 nt, Artificial Sequence
  derived and/or modified sequence opt2 from neuraminidase__InfluenzaA__ACU17262
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108682 - RNA, 1410 nt, Artificial Sequence; identical to SEQ ID NO: 108250
  derived and/or modified sequence opt2 from neuraminidase__InfluenzaA__ACU17325

SEQ ID NO: 108683 - RNA, 1410 nt, Artificial Sequence; identical to SEQ ID NO: 108250
  derived and/or modified sequence opt2 from neuraminidase__InfluenzaA__ACU17393

SEQ ID NO: 108684 - RNA, 1410 nt, Artificial Sequence; identical to SEQ ID NO: 108250
  derived and/or modified sequence opt2 from neuraminidase__InfluenzaA__ACU17454

SEQ ID NO: 108685 - RNA, 1410 nt, Artificial Sequence; identical to SEQ ID NO: 108250
  derived and/or modified sequence opt2 from neuraminidase__InfluenzaA__ACU17524

SEQ ID NO: 108686 - RNA, 1410 nt, Artificial Sequence; identical to SEQ ID NO: 108604
  derived and/or modified sequence opt2 from neuraminidase__InfluenzaA__ACU27043

SEQ ID NO: 108687 - RNA, 1413 nt, Artificial Sequence
  derived and/or modified sequence opt2 from neuraminidase__InfluenzaA__ACU27415
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucaccuucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108688 - RNA, 1413 nt, Artificial Sequence; identical to SEQ ID NO: 108687
  derived and/or modified sequence opt2 from neuraminidase__InfluenzaA__ACU27416

SEQ ID NO: 108689 - RNA, 1410 nt, Artificial Sequence; identical to SEQ ID NO: 108240
  derived and/or modified sequence opt2 from neuraminidase__InfluenzaA__ACU29961

SEQ ID NO: 108690 - RNA, 1410 nt, Artificial Sequence
  derived and/or modified sequence opt2 from neuraminidase__InfluenzaA__ACU29971
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccugguccgacggcgccgagcuccccuucaccaucgacaaguga

SEQ ID NO: 108691 - RNA, 1410 nt, Artificial Sequence; identical to SEQ ID NO: 108250
  derived and/or modified sequence opt2 from neuraminidase__InfluenzaA__ACU29981

SEQ ID NO: 108692 - RNA, 1410 nt, Artificial Sequence; identical to SEQ ID NO: 108250
  derived and/or modified sequence opt2 from neuraminidase__InfluenzaA__ACU29991

SEQ ID NO: 108693 - RNA, 1410 nt, Artificial Sequence; identical to SEQ ID NO: 108250
  derived and/or modified sequence opt2 from neuraminidase__InfluenzaA__ACU30001

SEQ ID NO: 108694 - RNA, 1410 nt, Artificial Sequence; identical to SEQ ID NO: 108250
  derived and/or modified sequence opt2 from neuraminidase__InfluenzaA__ACU30021

SEQ ID NO: 108695 - RNA, 1410 nt, Artificial Sequence
  derived and/or modified sequence opt2 from neuraminidase__InfluenzaA__ACU30085
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucaugggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108696 - RNA, 1410 nt, Artificial Sequence; identical to SEQ ID NO: 108674
  derived and/or modified sequence opt2 from neuraminidase__InfluenzaA__ACU30095

SEQ ID NO: 108697 - RNA, 1410 nt, Artificial Sequence; identical to SEQ ID NO: 108250
  derived and/or modified sequence opt2 from neuraminidase__InfluenzaA__ACU30105

SEQ ID NO: 108698 - RNA, 1410 nt, Artificial Sequence; identical to SEQ ID NO: 108250
  derived and/or modified sequence opt2 from neuraminidase__InfluenzaA__ACU30114

SEQ ID NO: 108699 - RNA, 1410 nt, Artificial Sequence; identical to SEQ ID NO: 108250
  derived and/or modified sequence opt2 from neuraminidase__InfluenzaA__ACU30123

SEQ ID NO: 108700 - RNA, 1410 nt, Artificial Sequence
  derived and/or modified sequence opt2 from neuraminidase__InfluenzaA__ACU31177
augaaccccaaccagaagaucaucaccaucggcuccgucugcaugaccaucggcauggccaaccucauccuccagaucggcaacaucaucuccaucuggaucucccaccucauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108701 - RNA, 1410 nt, Artificial Sequence; identical to SEQ ID NO: 108250
  derived and/or modified sequence opt2 from neuraminidase__InfluenzaA__ACU31178

SEQ ID NO: 108702 - RNA, 1410 nt, Artificial Sequence; identical to SEQ ID NO: 108240
  derived and/or modified sequence opt2 from neuraminidase__InfluenzaA__ACU31179

SEQ ID NO: 108703 - RNA, 1410 nt, Artificial Sequence; identical to SEQ ID NO: 108240
  derived and/or modified sequence opt2 from neuraminidase__InfluenzaA__ACU31180

SEQ ID NO: 108704 - RNA, 1410 nt, Artificial Sequence; identical to SEQ ID NO: 108240
  derived and/or modified sequence opt2 from neuraminidase__InfluenzaA__ACU31181

SEQ ID NO: 108705 - RNA, 1410 nt, Artificial Sequence; identical to SEQ ID NO: 108250
  derived and/or modified sequence opt2 from neuraminidase__InfluenzaA__ACU31182

SEQ ID NO: 108706 - RNA, 1410 nt, Artificial Sequence; identical to SEQ ID NO: 108280
  derived and/or modified sequence opt2 from neuraminidase__InfluenzaA__ACU31183

SEQ ID NO: 108707 - RNA, 1410 nt, Artificial Sequence; identical to SEQ ID NO: 108250
  derived and/or modified sequence opt2 from neuraminidase__InfluenzaA__ACU31184

SEQ ID NO: 108708 - RNA, 1410 nt, Artificial Sequence; identical to SEQ ID NO: 108240
  derived and/or modified sequence opt2 from neuraminidase__InfluenzaA__ACU31185

SEQ ID NO: 108709 - RNA, 1410 nt, Artificial Sequence; identical to SEQ ID NO: 108240
  derived and/or modified sequence opt2 from neuraminidase__InfluenzaA__ACU31186

SEQ ID NO: 108710 - RNA, 1410 nt, Artificial Sequence; identical to SEQ ID NO: 108240
  derived and/or modified sequence opt2 from neuraminidase__InfluenzaA__ACU31187

SEQ ID NO: 108711 - RNA, 1410 nt, Artificial Sequence; identical to SEQ ID NO: 108240
  derived and/or modified sequence opt2 from neuraminidase__InfluenzaA__ACU31188

SEQ ID NO: 108712 - RNA, 1350 nt, Artificial Sequence
  derived and/or modified sequence opt2 from neuraminidase__InfluenzaA__ACU46645
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaaccuccucaccgagaagaccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccggccccgucggcgaggcccccucccccuacaacucccgcuucgaguacgucgccugguccgccuccgccugccacgaccgcaccucccgccucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcgccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 108713 - RNA, 1410 nt, Artificial Sequence
  derived and/or modified sequence opt2 from neuraminidase__InfluenzaA__ACU56927
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgacaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108714 - RNA, 1410 nt, Artificial Sequence; identical to SEQ ID NO: 108405
  derived and/or modified sequence opt2 from neuraminidase__InfluenzaA__ACU56934

SEQ ID NO: 108715 - RNA, 1410 nt, Artificial Sequence; identical to SEQ ID NO: 108250
  derived and/or modified sequence opt2 from neuraminidase__InfluenzaA__ACU64791

SEQ ID NO: 108716 - RNA, 1410 nt, Artificial Sequence
  derived and/or modified sequence opt2 from neuraminidase__InfluenzaA__ACU64811
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccauggucuccgucaagcucgccggcaacuccucccucugccccgucuccggcugggccaucuacuccaaggacaacuccguccgcaucggcuccaagggcgacgucuucaucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108717 - RNA, 1410 nt, Artificial Sequence; identical to SEQ ID NO: 108015
  derived and/or modified sequence opt2 from neuraminidase__InfluenzaA__ACU79885

SEQ ID NO: 108718 - RNA, 1410 nt, Artificial Sequence; identical to SEQ ID NO: 105607
  derived and/or modified sequence opt2 from neuraminidase__InfluenzaA__ACU79896

SEQ ID NO: 108719 - RNA, 1410 nt, Artificial Sequence; identical to SEQ ID NO: 105607
  derived and/or modified sequence opt2 from neuraminidase__InfluenzaA__ACU79918

SEQ ID NO: 108720 - RNA, 1410 nt, Artificial Sequence; identical to SEQ ID NO: 105607
  derived and/or modified sequence opt2 from neuraminidase__InfluenzaA__ACU79929

SEQ ID NO: 108721 - RNA, 1413 nt, Artificial Sequence
  derived and/or modified sequence opt2 from neuraminidase__InfluenzaA__ACU79940
augaaccccaaccagaagaucaucaccaucggcuccaucuccaucgucaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacucccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuaccgcuacggcaacggcgucuggaucggccgcaccaaguccaaccgccuccgcaagggcuucgagaugaucugggaccccaacggcuggaccgacaccgacuccgacuucuccgucaagcaggacgucgucgccaugaccgacugguccggcuacuccggcuccuucguccagcaccccgagcucaccggccucgacugcauccgccccugcuucugggucgagcucguccgcggccgcccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108722 - RNA, 1410 nt, Artificial Sequence
  derived and/or modified sequence opt2 from neuraminidase__InfluenzaA__ACU79951
augaaccccaaccagaagaucaucaccaucggcuccgucucccucaccaucgagaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucggcaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 108723 - RNA, 1410 nt, Artificial Sequence; identical to SEQ ID NO: 108115
  derived and/or modified sequence opt2 from neuraminidase__InfluenzaA__ACU79973

SEQ ID NO: 108724 - RNA, 1413 nt, Artificial Sequence; identical to SEQ ID NO: 108144
  derived and/or modified sequence opt2 from neuraminidase__InfluenzaA__ACU79984

SEQ ID NO: 108725 - RNA, 1410 nt, Artificial Sequence; identical to SEQ ID NO: 108111
  derived and/or modified sequence opt2 from neuraminidase__InfluenzaA__ACU80006

SEQ ID NO: 108726 - RNA, 1410 nt, Artificial Sequence
  derived and/or modified sequence opt2 from neuraminidase__InfluenzaA__ACU80017
augaacaccaaccagcgcaucaucaccaucggcaccaucugccucaucgucggcaucaucucccuccuccuccagaucggcaacaucauccuccucuggaugucccacuccauccagaccggcgagaagucccaccccaaggucugcaaccaguccgucaucaccuacgagaacaacaccugggucaaccagaccuacgucaacaucuccaacaccaacaucgccgccggccagggcgucacccccaucauccucgccggcaacuccucccucugccccaucuccggcugggccaucuacuccaaggacaacuccauccgcaucggcuccaagggcgacaucuucgucaugcgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaacaagauccuccgcacccaggaguccgagugcgucugcaucaacggcuccugcuucaccaucaugaccgacggccccuccaacggccaggccuccuacaagcucuucaagauggagaagggcaagaucauccgcuccaucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucugcuccggcgucuucggcgacaacccccgcuccaacgacggcaagggcaacugcggccccguccucuccaacggcgccaacggcgucaagggcuucuccuuccgcuacggcaacggcgucuggaucggccgcaccaaguccaucuccucccgcuccggcuucgagaugaucugggaccccaacggcuggaccgagaccgacuccuccuucuccaugaagcaggacaucaucgcccucaccgacugguccggcuacuccggcuccuucguccagcaccccgagcucaccggcaugaacugcauccgccccugcuucugggucgagcucauccgcggccagcccaaggaguccaccaucuggaccuccggcuccuccaucuccuucugcggcgucaacuccggcaccgccuccugguccuggcccgacggcgccgaccuccccuucaccaucgacaaguga

SEQ ID NO: 108727 - RNA, 1413 nt, Artificial Sequence; identical to SEQ ID NO: 108144
  derived and/or modified sequence opt2 from neuraminidase__InfluenzaA__ACU80028

SEQ ID NO: 108728 - RNA, 1410 nt, Artificial Sequence; identical to SEQ ID NO: 108111
  derived and/or modified sequence opt2 from neuraminidase__InfluenzaA__ACU80039

SEQ ID NO: 108729 - RNA, 1413 nt, Artificial Sequence; identical to SEQ ID NO: 108228
  derived and/or modified sequence opt2 from neuraminidase__InfluenzaA__ACU80050

SEQ ID NO: 108730 - RNA, 1410 nt, Artificial Sequence; identical to SEQ ID NO: 108661
  derived and/or modified sequence opt2 from neuraminidase__InfluenzaA__ACU80061

SEQ ID NO: 108731 - RNA, 1413 nt, Artificial Sequence; identical to SEQ ID NO: 108144
  derived and/or modified sequence opt2 from neuraminidase__InfluenzaA__ACU80072

SEQ ID NO: 108732 - RNA, 1413 nt, Artificial Sequence; identical to SEQ ID NO: 108144
  derived and/or modified sequence opt2 from neuraminidase__InfluenzaA__ACU80094

SEQ ID NO: 108733 - RNA, 1410 nt, Artificial Sequence; identical to SEQ ID NO: 108115
  derived and/or modified sequence opt2 from neuraminidase__InfluenzaA__ACU80105

SEQ ID NO: 108734 - RNA, 1410 nt, Artificial Sequence; identical to SEQ ID NO: 108115
  derived and/or modified sequence opt2 from neuraminidase__InfluenzaA__ACU80127

SEQ ID NO: 108735 - RNA, 1410 nt, Artificial Sequence; identical to SEQ ID NO: 108115
  derived and/or modified sequence opt2 from neuraminidase__InfluenzaA__ACU80138

SEQ ID NO: 108736 - RNA, 1410 nt, Artificial Sequence; identical to SEQ ID NO: 108111
  derived and/or modified sequence opt2 from neuraminidase__InfluenzaA__ACU80160

SEQ ID NO: 108737 - RNA, 1413 nt, Artificial Sequence; identical to SEQ ID NO: 108144
  derived and/or modified sequence opt2 from neuraminidase__InfluenzaA__ACU80171

SEQ ID NO: 108738 - RNA, 1410 nt, Artificial Sequence; identical to SEQ ID NO: 108024
  derived and/or modified sequence opt2 from neuraminidase__InfluenzaA__ACU80182

SEQ ID NO: 108739 - RNA, 1410 nt, Artificial Sequence
  derived and/or modified sequence opt2 from neuraminidase__InfluenzaA__ACU80193
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108740 - RNA, 1410 nt, Artificial Sequence; identical to SEQ ID NO: 108024
  derived and/or modified sequence opt2 from neuraminidase__InfluenzaA__ACU80204

SEQ ID NO: 108741 - RNA, 1413 nt, Artificial Sequence
  derived and/or modified sequence opt2 from neuraminidase__InfluenzaA__ACU80237
augaaccccaaccagaagaucaucaccaucggcuccaucuccaucgccaucggcaucaucucccucaugcuccagaucggcaacaucaucuccaucugggccucccacuccauccagaccggcaaccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108742 - RNA, 1410 nt, Artificial Sequence; identical to SEQ ID NO: 108115
  derived and/or modified sequence opt2 from neuraminidase__InfluenzaA__ACU80248

SEQ ID NO: 108743 - RNA, 1410 nt, Artificial Sequence; identical to SEQ ID NO: 108115
  derived and/or modified sequence opt2 from neuraminidase__InfluenzaA__ACU80259

SEQ ID NO: 108744 - RNA, 1413 nt, Artificial Sequence
  derived and/or modified sequence opt2 from neuraminidase__InfluenzaA__ACU80270
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccuccaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108745 - RNA, 1413 nt, Artificial Sequence
  derived and/or modified sequence opt2 from neuraminidase__InfluenzaA__ACU80281
augaaccagaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108746 - RNA, 1410 nt, Artificial Sequence
  derived and/or modified sequence opt2 from neuraminidase__InfluenzaA__ACU80303
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggcaacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108747 - RNA, 1410 nt, Artificial Sequence; identical to SEQ ID NO: 108115
  derived and/or modified sequence opt2 from neuraminidase__InfluenzaA__ACU80314

SEQ ID NO: 108748 - RNA, 1410 nt, Artificial Sequence; identical to SEQ ID NO: 108115
  derived and/or modified sequence opt2 from neuraminidase__InfluenzaA__ACU80325

SEQ ID NO: 108749 - RNA, 1410 nt, Artificial Sequence; identical to SEQ ID NO: 108111
  derived and/or modified sequence opt2 from neuraminidase__InfluenzaA__ACU80336

SEQ ID NO: 108750 - RNA, 1410 nt, Artificial Sequence; identical to SEQ ID NO: 108115
  derived and/or modified sequence opt2 from neuraminidase__InfluenzaA__ACU80347

SEQ ID NO: 108751 - RNA, 1410 nt, Artificial Sequence; identical to SEQ ID NO: 108115
  derived and/or modified sequence opt2 from neuraminidase__InfluenzaA__ACU80358

SEQ ID NO: 108752 - RNA, 1410 nt, Artificial Sequence; identical to SEQ ID NO: 108115
  derived and/or modified sequence opt2 from neuraminidase__InfluenzaA__ACU80369

SEQ ID NO: 108753 - RNA, 1410 nt, Artificial Sequence; identical to SEQ ID NO: 108115
  derived and/or modified sequence opt2 from neuraminidase__InfluenzaA__ACU80380

SEQ ID NO: 108754 - RNA, 1410 nt, Artificial Sequence
  derived and/or modified sequence opt2 from neuraminidase__InfluenzaA__ACU80391
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaucaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108755 - RNA, 1410 nt, Artificial Sequence; identical to SEQ ID NO: 108111
  derived and/or modified sequence opt2 from neuraminidase__InfluenzaA__ACU80402

SEQ ID NO: 108756 - RNA, 1413 nt, Artificial Sequence; identical to SEQ ID NO: 108144
  derived and/or modified sequence opt2 from neuraminidase__InfluenzaA__ACU80413

SEQ ID NO: 108757 - RNA, 1410 nt, Artificial Sequence; identical to SEQ ID NO: 108115
  derived and/or modified sequence opt2 from neuraminidase__InfluenzaA__ACU80427

SEQ ID NO: 108758 - RNA, 1410 nt, Artificial Sequence; identical to SEQ ID NO: 108115
  derived and/or modified sequence opt2 from neuraminidase__InfluenzaA__ACU80438

SEQ ID NO: 108759 - RNA, 1410 nt, Artificial Sequence; identical to SEQ ID NO: 108111
  derived and/or modified sequence opt2 from neuraminidase__InfluenzaA__ACU80461

SEQ ID NO: 108760 - RNA, 1410 nt, Artificial Sequence; identical to SEQ ID NO: 108115
  derived and/or modified sequence opt2 from neuraminidase__InfluenzaA__ACU80603

SEQ ID NO: 108761 - RNA, 1410 nt, Artificial Sequence; identical to SEQ ID NO: 108115
  derived and/or modified sequence opt2 from neuraminidase__InfluenzaA__ACU80614

SEQ ID NO: 108762 - RNA, 1410 nt, Artificial Sequence; identical to SEQ ID NO: 108115
  derived and/or modified sequence opt2 from neuraminidase__InfluenzaA__ACU80625

SEQ ID NO: 108763 - RNA, 1410 nt, Artificial Sequence; identical to SEQ ID NO: 108111
  derived and/or modified sequence opt2 from neuraminidase__InfluenzaA__ACU80636

SEQ ID NO: 108764 - RNA, 1410 nt, Artificial Sequence
  derived and/or modified sequence opt2 from neuraminidase__InfluenzaA__ACU80647
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108765 - RNA, 1410 nt, Artificial Sequence
  derived and/or modified sequence opt2 from neuraminidase__InfluenzaA__ACU80658
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaagaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108766 - RNA, 1410 nt, Artificial Sequence; identical to SEQ ID NO: 108024
  derived and/or modified sequence opt2 from neuraminidase__InfluenzaA__ACU80669

SEQ ID NO: 108767 - RNA, 1410 nt, Artificial Sequence; identical to SEQ ID NO: 108111
  derived and/or modified sequence opt2 from neuraminidase__InfluenzaA__ACU80691

SEQ ID NO: 108768 - RNA, 1410 nt, Artificial Sequence; identical to SEQ ID NO: 108115
  derived and/or modified sequence opt2 from neuraminidase__InfluenzaA__ACU80702

SEQ ID NO: 108769 - RNA, 1410 nt, Artificial Sequence; identical to SEQ ID NO: 108115
  derived and/or modified sequence opt2 from neuraminidase__InfluenzaA__ACU80713

SEQ ID NO: 108770 - RNA, 1410 nt, Artificial Sequence; identical to SEQ ID NO: 108111
  derived and/or modified sequence opt2 from neuraminidase__InfluenzaA__ACU80724

SEQ ID NO: 108771 - RNA, 1410 nt, Artificial Sequence; identical to SEQ ID NO: 108024
  derived and/or modified sequence opt2 from neuraminidase__InfluenzaA__ACU80735

SEQ ID NO: 108772 - RNA, 1410 nt, Artificial Sequence; identical to SEQ ID NO: 108111
  derived and/or modified sequence opt2 from neuraminidase__InfluenzaA__ACU80746

SEQ ID NO: 108773 - RNA, 1410 nt, Artificial Sequence
  derived and/or modified sequence opt2 from neuraminidase__InfluenzaA__ACU80757
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgaggucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108774 - RNA, 1410 nt, Artificial Sequence; identical to SEQ ID NO: 108739
  derived and/or modified sequence opt2 from neuraminidase__InfluenzaA__ACU80768

SEQ ID NO: 108775 - RNA, 1410 nt, Artificial Sequence; identical to SEQ ID NO: 108111
  derived and/or modified sequence opt2 from neuraminidase__InfluenzaA__ACU80779

SEQ ID NO: 108776 - RNA, 1410 nt, Artificial Sequence; identical to SEQ ID NO: 108024
  derived and/or modified sequence opt2 from neuraminidase__InfluenzaA__ACU80790

SEQ ID NO: 108777 - RNA, 1410 nt, Artificial Sequence; identical to SEQ ID NO: 108111
  derived and/or modified sequence opt2 from neuraminidase__InfluenzaA__ACU80801

SEQ ID NO: 108778 - RNA, 1410 nt, Artificial Sequence
  derived and/or modified sequence opt2 from neuraminidase__InfluenzaA__ACU81106
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaacuccuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108779 - RNA, 1410 nt, Artificial Sequence; identical to SEQ ID NO: 108405
  derived and/or modified sequence opt2 from neuraminidase__InfluenzaA__ACU87265

SEQ ID NO: 108780 - RNA, 1410 nt, Artificial Sequence; identical to SEQ ID NO: 108250
  derived and/or modified sequence opt2 from neuraminidase__InfluenzaA__ACU87273

SEQ ID NO: 108781 - RNA, 1410 nt, Artificial Sequence; identical to SEQ ID NO: 108250
  derived and/or modified sequence opt2 from neuraminidase__InfluenzaA__ACV04231

SEQ ID NO: 108782 - RNA, 1410 nt, Artificial Sequence; identical to SEQ ID NO: 108250
  derived and/or modified sequence opt2 from neuraminidase__InfluenzaA__ACV04241

SEQ ID NO: 108783 - RNA, 1410 nt, Artificial Sequence; identical to SEQ ID NO: 108250
  derived and/or modified sequence opt2 from neuraminidase__InfluenzaA__ACV04251

SEQ ID NO: 108784 - RNA, 1410 nt, Artificial Sequence; identical to SEQ ID NO: 108250
  derived and/or modified sequence opt2 from neuraminidase__InfluenzaA__ACV04261

SEQ ID NO: 108785 - RNA, 1410 nt, Artificial Sequence; identical to SEQ ID NO: 108250
  derived and/or modified sequence opt2 from neuraminidase__InfluenzaA__ACV04271

SEQ ID NO: 108786 - RNA, 1410 nt, Artificial Sequence
  derived and/or modified sequence opt2 from neuraminidase__InfluenzaA__ACV04281
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucggcaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108787 - RNA, 1410 nt, Artificial Sequence; identical to SEQ ID NO: 108250
  derived and/or modified sequence opt2 from neuraminidase__InfluenzaA__ACV04291

SEQ ID NO: 108788 - RNA, 1410 nt, Artificial Sequence; identical to SEQ ID NO: 108250
  derived and/or modified sequence opt2 from neuraminidase__InfluenzaA__ACV04301

SEQ ID NO: 108789 - RNA, 1410 nt, Artificial Sequence; identical to SEQ ID NO: 108250
  derived and/or modified sequence opt2 from neuraminidase__InfluenzaA__ACV04321

SEQ ID NO: 108790 - RNA, 1410 nt, Artificial Sequence; identical to SEQ ID NO: 108250
  derived and/or modified sequence opt2 from neuraminidase__InfluenzaA__ACV04331

SEQ ID NO: 108791 - RNA, 1410 nt, Artificial Sequence; identical to SEQ ID NO: 108250
  derived and/or modified sequence opt2 from neuraminidase__InfluenzaA__ACV04341

SEQ ID NO: 108792 - RNA, 1410 nt, Artificial Sequence; identical to SEQ ID NO: 108250
  derived and/or modified sequence opt2 from neuraminidase__InfluenzaA__ACV04351

SEQ ID NO: 108793 - RNA, 1410 nt, Artificial Sequence; identical to SEQ ID NO: 108250
  derived and/or modified sequence opt2 from neuraminidase__InfluenzaA__ACV04361

SEQ ID NO: 108794 - RNA, 1410 nt, Artificial Sequence; identical to SEQ ID NO: 108250
  derived and/or modified sequence opt2 from neuraminidase__InfluenzaA__ACV04371

SEQ ID NO: 108795 - RNA, 1410 nt, Artificial Sequence; identical to SEQ ID NO: 108250
  derived and/or modified sequence opt2 from neuraminidase__InfluenzaA__ACV04381

SEQ ID NO: 108796 - RNA, 1410 nt, Artificial Sequence; identical to SEQ ID NO: 108250
  derived and/or modified sequence opt2 from neuraminidase__InfluenzaA__ACV04391

SEQ ID NO: 108797 - RNA, 1410 nt, Artificial Sequence; identical to SEQ ID NO: 108250
  derived and/or modified sequence opt2 from neuraminidase__InfluenzaA__ACV04401

SEQ ID NO: 108798 - RNA, 1410 nt, Artificial Sequence; identical to SEQ ID NO: 108240
  derived and/or modified sequence opt2 from neuraminidase__InfluenzaA__ACV04411

SEQ ID NO: 108799 - RNA, 1410 nt, Artificial Sequence; identical to SEQ ID NO: 108250
  derived and/or modified sequence opt2 from neuraminidase__InfluenzaA__ACV04492

SEQ ID NO: 108800 - RNA, 1410 nt, Artificial Sequence; identical to SEQ ID NO: 108250
  derived and/or modified sequence opt2 from neuraminidase__InfluenzaA__ACV04502

SEQ ID NO: 108801 - RNA, 1410 nt, Artificial Sequence; identical to SEQ ID NO: 108240
  derived and/or modified sequence opt2 from neuraminidase__InfluenzaA__ACV04512

SEQ ID NO: 108802 - RNA, 1410 nt, Artificial Sequence
  derived and/or modified sequence opt2 from neuraminidase__InfluenzaA__ACV04522
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggcaaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108803 - RNA, 1410 nt, Artificial Sequence; identical to SEQ ID NO: 108250
  derived and/or modified sequence opt2 from neuraminidase__InfluenzaA__ACV04532

SEQ ID NO: 108804 - RNA, 1410 nt, Artificial Sequence; identical to SEQ ID NO: 108250
  derived and/or modified sequence opt2 from neuraminidase__InfluenzaA__ACV04542

SEQ ID NO: 108805 - RNA, 1410 nt, Artificial Sequence; identical to SEQ ID NO: 108250
  derived and/or modified sequence opt2 from neuraminidase__InfluenzaA__ACV04552

SEQ ID NO: 108806 - RNA, 1410 nt, Artificial Sequence; identical to SEQ ID NO: 108250
  derived and/or modified sequence opt2 from neuraminidase__InfluenzaA__ACV04562

SEQ ID NO: 108807 - RNA, 1410 nt, Artificial Sequence; identical to SEQ ID NO: 108240
  derived and/or modified sequence opt2 from neuraminidase__InfluenzaA__ACV04572

SEQ ID NO: 108808 - RNA, 1410 nt, Artificial Sequence; identical to SEQ ID NO: 108250
  derived and/or modified sequence opt2 from neuraminidase__InfluenzaA__ACV04582

SEQ ID NO: 108809 - RNA, 1410 nt, Artificial Sequence
  derived and/or modified sequence opt2 from neuraminidase__InfluenzaA__ACV04758
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108810 - RNA, 1410 nt, Artificial Sequence; identical to SEQ ID NO: 108240
  derived and/or modified sequence opt2 from neuraminidase__InfluenzaA__ACV33087

SEQ ID NO: 108811 - RNA, 1410 nt, Artificial Sequence; identical to SEQ ID NO: 108250
  derived and/or modified sequence opt2 from neuraminidase__InfluenzaA__ACV33107

SEQ ID NO: 108812 - RNA, 1410 nt, Artificial Sequence; identical to SEQ ID NO: 108250
  derived and/or modified sequence opt2 from neuraminidase__InfluenzaA__ACV33117

SEQ ID NO: 108813 - RNA, 1410 nt, Artificial Sequence; identical to SEQ ID NO: 108250
  derived and/or modified sequence opt2 from neuraminidase__InfluenzaA__ACV33127

SEQ ID NO: 108814 - RNA, 1410 nt, Artificial Sequence; identical to SEQ ID NO: 108250
  derived and/or modified sequence opt2 from neuraminidase__InfluenzaA__ACV33137

SEQ ID NO: 108815 - RNA, 1410 nt, Artificial Sequence; identical to SEQ ID NO: 108250
  derived and/or modified sequence opt2 from neuraminidase__InfluenzaA__ACV33147

SEQ ID NO: 108816 - RNA, 1410 nt, Artificial Sequence
  derived and/or modified sequence opt2 from neuraminidase__InfluenzaA__ACV33157
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccgucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108817 - RNA, 1410 nt, Artificial Sequence
  derived and/or modified sequence opt2 from neuraminidase__InfluenzaA__ACV33167
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 108818 - RNA, 1410 nt, Artificial Sequence; identical to SEQ ID NO: 108250
  derived and/or modified sequence opt2 from neuraminidase__InfluenzaA__ACV33177

SEQ ID NO: 108819 - RNA, 1410 nt, Artificial Sequence
  derived and/or modified sequence opt2 from neuraminidase__InfluenzaA__ACV41993
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaucugcaaccaguccgucaucaccuacgagaacaacaccugggucaaccagaccuacgucaacaucuccaacaccaacuucgccgccggccaguccgucgucuccgucaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108820 - RNA, 1410 nt, Artificial Sequence; identical to SEQ ID NO: 108250
  derived and/or modified sequence opt2 from neuraminidase__InfluenzaA__ACV42010

SEQ ID NO: 108821 - RNA, 1410 nt, Artificial Sequence; identical to SEQ ID NO: 108250
  derived and/or modified sequence opt2 from neuraminidase__InfluenzaA__ACV42020

SEQ ID NO: 108822 - RNA, 1410 nt, Artificial Sequence; identical to SEQ ID NO: 108015
  derived and/or modified sequence opt2 from neuraminidase__InfluenzaA__ACV49504

SEQ ID NO: 108823 - RNA, 1362 nt, Artificial Sequence
  derived and/or modified sequence opt2 from neuraminidase__InfluenzaA__ACV49537
augaaccccaaccagaagaucaucaccaucggcuccaucugcauggucgucggcaucaucucccucauccuccagaucggcaacaucaucuccaucuggaucucccacuccauccagaccggcaaccagaaccacaccggcaucugcaaccagggcaucaucaccuacaacgucgucgccggccaggacuccaccuccgucauccucaccggcaacuccucccucugccccauccgcggcugggccauccacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcgccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcaccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuccgccgacggcgccaacggcgucaagggcuucuccuaccgcuacggcaacggcgucuggaucggccgcaccaaguccgacuccucccgccacggcuucgagaugaucugggaccccaacggcuggaccgagaccgacucccgcuucuccguccgccaggacgucgucgccaugaccgaccgcuccggcuacuccggcuccuucguccagcaccccgagcucaccggccucgacugcaugcgccccugcuucugggucgagcucauccgcggccgccccgaggagaagaccaucuggaccuccggcuccaucaucuccuucugcggcgucaacuccgacaccgucgacugguccuggcccgacggcgccgagcuccccuucaccaucgacaaguga

SEQ ID NO: 108824 - RNA, 1362 nt, Artificial Sequence
  derived and/or modified sequence opt2 from neuraminidase__InfluenzaA__ACV49559
augaaccccaaccagaagaucaucaccaucggcuccaucugcauggucgucggcaucaucucccucauccuccagaucggcaacaucaucuccaucuggaucucccacuccauccaggccggcuccuccaccugggucaaccagaccuacgucaacaucuccaacaccaacgucgucgccggccaggacgccaccuccgucauccucaccggcaacuccucccucugccccauccgcggcugggccaucuacuccaaggacaacggcauccgcaucggcuccaagggcgacaucuucgucauccgcgagcccuucaucuccugcucccaccucgagugccgcgccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccccgccuccuacaagaucuucaagaucgagaagggcaaggucaccaaguccaucgagcucgacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaccccccgccccaaggacggcaccggcuccugcggccccgucuccgucgacggcgccaacggcgucaagggcuucuccuaccgcuacggcgacggcgucuggaucggccgcaccaagucccaguccucccgccacggcuucgagaugaucugggaccccaacggcuggaccgagaccgacucccgcuucuccguccgccaggacgucgucgccaucaccgacugguccggcuacuccggcuccuucguccagcaccccgagcucaccggccucgacugcaugcgccccugcuucugggucgagcucauccgcggccagcccaaggagaagaccaucuggaccuccggcuccuccaucuccuucugcggcgucaacuccgacaccgucgacugguccuggcccgacggcgccgagcuccccuucaccaucgacaaguga

SEQ ID NO: 108825 - RNA, 1395 nt, Artificial Sequence
  derived and/or modified sequence opt2 from neuraminidase__InfluenzaA__ACV49570
augaaccccaaccagaagaucaucaccaucggcuccaucugcauggucgucggcaucaucucccucauccuccagaucggcaacaucgucuccaucuggaucucccacuccauccagaccggcaaccagaaccacaccggcaccugcgaccaguccaucaucaccuacaagaacuccaccugggucaaccagaccuacgucaacgucgucgccggcaaggacaccaccuccgucauccucgccggcaacuccucccucugccccauccgcggcugggccaucuacuccaaggacaacggcguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaaggagauccuccgcacccaggaguccgagugcgucugcgucaacggcuccugcuucaccaucaugaccgacggccccuccggcggccccgccuccuacaagaucuucaagaucgagaagggcaaggucaccaaguccaucgagcucgacgcccccaacucccacuacgaggagugcuccugcuaccccgacaccuccaaggucaugugcgucugccgcgacaacuggcacggcuccaaccgccccugggucuccuucgaccagaaccucgacuaccagaugggcuacaucugcuccggcgucuucggcgacaacccccgccccaaggacggcaagggcuccugcggccccgucuacgucgacggcgccaacggcgucaagggcuucuccuacaaguacggcaacggcgucuggaucggccgcaccaaguccaacuccucccgccagggcuucgagaugaucugggaccccaacggcuggaccgagaccgacuccaacuucuucaccaagcaggacgucgucgccgucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 108826 - RNA, 1410 nt, Artificial Sequence; identical to SEQ ID NO: 107916
  derived and/or modified sequence opt2 from neuraminidase__InfluenzaA__ACV49581

SEQ ID NO: 108827 - RNA, 1410 nt, Artificial Sequence; identical to SEQ ID NO: 107916
  derived and/or modified sequence opt2 from neuraminidase__InfluenzaA__ACV49592

SEQ ID NO: 108828 - RNA, 1410 nt, Artificial Sequence
  derived and/or modified sequence opt2 from neuraminidase__InfluenzaA__ACV49603
augaaccccaaccagaagaucaucaccaucggcuccgucucccucaccaucgagaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 108829 - RNA, 1410 nt, Artificial Sequence
  derived and/or modified sequence opt2 from neuraminidase__InfluenzaA__ACV49625
augaaccccaaccagaagaccaucaccaucggcuccgucucccucaccaucgagaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcggccccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 108830 - RNA, 1410 nt, Artificial Sequence; identical to SEQ ID NO: 107968
  derived and/or modified sequence opt2 from neuraminidase__InfluenzaA__ACV49647

SEQ ID NO: 108831 - RNA, 1413 nt, Artificial Sequence
  derived and/or modified sequence opt2 from neuraminidase__InfluenzaA__ACV49669
augaaccccaaccagaagaucaucaccaucggcuccaucugcauggccaucggcaucaucucccucauccuccagaucggcaacaucgucuccaucuggaucucccacuccauccagaccggcucccagaacuacaccggcaucugcaaccagcgcaucaucaccuacgagaacuccaccugggucaaccagaccuacgucaacaucaacaacaccaacgucgucgccggccaggacaccaccuccgucacccucgccggcaacuccucccucugccccaucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccaucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaagcgcauccuccgcacccaggaguccgagugcgucugcgucaacggcuccugcuucaccaucaugaccgacggccccaacaacggccccgccuccuacaagaucuucaagaucgagaagggcaagaucaccaaguccaucgagcucgacgcccccaacucccacuacgaggagugcuccugcuaccccgacgccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcggccccgucaccgucgacggcgccgacggcgucaagggcuucuccuaccgcuacggcaacggcgucuggaucggccgcaccaaguccaacuccucccgccgcggcuucgagaugaucugggaccccaacggcuggaccgacaccgacuccaaguuccucgucaagcaggacgucgucgccaugaccgacugguccggcuacuccggcuccuucguccagcaccccgagcucaccggccucgacugcaugcgccccugcuucugggucgagcucauccgcggccgcccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 108832 - RNA, 1413 nt, Artificial Sequence
  derived and/or modified sequence opt2 from neuraminidase__InfluenzaA__ACV49679
augaaccccaaccagaagaucaucaccaucggcuccaucuccaucgccaucggcaucaucucccucaugcuccagaucggcuccaucaucuccaucugggccucccacuccauccgcaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108833 - RNA, 1410 nt, Artificial Sequence
  derived and/or modified sequence opt2 from neuraminidase__InfluenzaA__ACV53442
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108834 - RNA, 1410 nt, Artificial Sequence; identical to SEQ ID NO: 108617
  derived and/or modified sequence opt2 from neuraminidase__InfluenzaA__ACV53452

SEQ ID NO: 108835 - RNA, 1410 nt, Artificial Sequence; identical to SEQ ID NO: 108240
  derived and/or modified sequence opt2 from neuraminidase__InfluenzaA__ACV53462

SEQ ID NO: 108836 - RNA, 1410 nt, Artificial Sequence; identical to SEQ ID NO: 108250
  derived and/or modified sequence opt2 from neuraminidase__InfluenzaA__ACV53472

SEQ ID NO: 108837 - RNA, 1410 nt, Artificial Sequence
  derived and/or modified sequence opt2 from neuraminidase__InfluenzaA__ACV53482
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgccaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108838 - RNA, 1410 nt, Artificial Sequence
  derived and/or modified sequence opt2 from neuraminidase__InfluenzaA__ACV53492
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaaggccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuuccucaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108839 - RNA, 1410 nt, Artificial Sequence
  derived and/or modified sequence opt2 from neuraminidase__InfluenzaA__ACV53502
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaaggccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuuccucaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108840 - RNA, 1410 nt, Artificial Sequence
  derived and/or modified sequence opt2 from neuraminidase__InfluenzaA__ACV53891
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaagauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugcgaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108841 - RNA, 1410 nt, Artificial Sequence
  derived and/or modified sequence opt2 from neuraminidase__InfluenzaA__ACV53901
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacucccgcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108842 - RNA, 1410 nt, Artificial Sequence; identical to SEQ ID NO: 108250
  derived and/or modified sequence opt2 from neuraminidase__InfluenzaA__ACV53911

SEQ ID NO: 108843 - RNA, 1410 nt, Artificial Sequence; identical to SEQ ID NO: 108240
  derived and/or modified sequence opt2 from neuraminidase__InfluenzaA__ACV67088

SEQ ID NO: 108844 - RNA, 1410 nt, Artificial Sequence; identical to SEQ ID NO: 108250
  derived and/or modified sequence opt2 from neuraminidase__InfluenzaA__ACV67168

SEQ ID NO: 108845 - RNA, 1410 nt, Artificial Sequence; identical to SEQ ID NO: 108240
  derived and/or modified sequence opt2 from neuraminidase__InfluenzaA__ACV67169

SEQ ID NO: 108846 - RNA, 1410 nt, Artificial Sequence; identical to SEQ ID NO: 108250
  derived and/or modified sequence opt2 from neuraminidase__InfluenzaA__ACV67171

SEQ ID NO: 108847 - RNA, 1410 nt, Artificial Sequence; identical to SEQ ID NO: 108250
  derived and/or modified sequence opt2 from neuraminidase__InfluenzaA__ACV67172

SEQ ID NO: 108848 - RNA, 1410 nt, Artificial Sequence; identical to SEQ ID NO: 108280
  derived and/or modified sequence opt2 from neuraminidase__InfluenzaA__ACV67173

SEQ ID NO: 108849 - RNA, 1410 nt, Artificial Sequence; identical to SEQ ID NO: 108240
  derived and/or modified sequence opt2 from neuraminidase__InfluenzaA__ACV67174

SEQ ID NO: 108850 - RNA, 1410 nt, Artificial Sequence
  derived and/or modified sequence opt2 from neuraminidase__InfluenzaA__ACV67175
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcuccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108851 - RNA, 1410 nt, Artificial Sequence; identical to SEQ ID NO: 108250
  derived and/or modified sequence opt2 from neuraminidase__InfluenzaA__ACV67176

SEQ ID NO: 108852 - RNA, 1410 nt, Artificial Sequence; identical to SEQ ID NO: 108240
  derived and/or modified sequence opt2 from neuraminidase__InfluenzaA__ACV67177

SEQ ID NO: 108853 - RNA, 1410 nt, Artificial Sequence; identical to SEQ ID NO: 108250
  derived and/or modified sequence opt2 from neuraminidase__InfluenzaA__ACV67178

SEQ ID NO: 108854 - RNA, 1410 nt, Artificial Sequence; identical to SEQ ID NO: 108250
  derived and/or modified sequence opt2 from neuraminidase__InfluenzaA__ACV67179

SEQ ID NO: 108855 - RNA, 1410 nt, Artificial Sequence
  derived and/or modified sequence opt2 from neuraminidase__InfluenzaA__ACV67180
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108856 - RNA, 1410 nt, Artificial Sequence
  derived and/or modified sequence opt2 from neuraminidase__InfluenzaA__ACV67181
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucaucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108857 - RNA, 1410 nt, Artificial Sequence; identical to SEQ ID NO: 108674
  derived and/or modified sequence opt2 from neuraminidase__InfluenzaA__ACV67182

SEQ ID NO: 108858 - RNA, 1410 nt, Artificial Sequence
  derived and/or modified sequence opt2 from neuraminidase__InfluenzaA__ACV67183
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccaacgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108859 - RNA, 1410 nt, Artificial Sequence; identical to SEQ ID NO: 108250
  derived and/or modified sequence opt2 from neuraminidase__InfluenzaA__ACV67184

SEQ ID NO: 108860 - RNA, 1410 nt, Artificial Sequence; identical to SEQ ID NO: 108240
  derived and/or modified sequence opt2 from neuraminidase__InfluenzaA__ACV67186

SEQ ID NO: 108861 - RNA, 1410 nt, Artificial Sequence; identical to SEQ ID NO: 108250
  derived and/or modified sequence opt2 from neuraminidase__InfluenzaA__ACV67187

SEQ ID NO: 108862 - RNA, 1410 nt, Artificial Sequence; identical to SEQ ID NO: 108250
  derived and/or modified sequence opt2 from neuraminidase__InfluenzaA__ACV67188

SEQ ID NO: 108863 - RNA, 1410 nt, Artificial Sequence; identical to SEQ ID NO: 108280
  derived and/or modified sequence opt2 from neuraminidase__InfluenzaA__ACV67189

SEQ ID NO: 108864 - RNA, 1410 nt, Artificial Sequence; identical to SEQ ID NO: 108280
  derived and/or modified sequence opt2 from neuraminidase__InfluenzaA__ACV67190

SEQ ID NO: 108865 - RNA, 1410 nt, Artificial Sequence; identical to SEQ ID NO: 108240
  derived and/or modified sequence opt2 from neuraminidase__InfluenzaA__ACV67191

SEQ ID NO: 108866 - RNA, 1410 nt, Artificial Sequence; identical to SEQ ID NO: 108280
  derived and/or modified sequence opt2 from neuraminidase__InfluenzaA__ACV67192

SEQ ID NO: 108867 - RNA, 1410 nt, Artificial Sequence; identical to SEQ ID NO: 108280
  derived and/or modified sequence opt2 from neuraminidase__InfluenzaA__ACV67193

SEQ ID NO: 108868 - RNA, 1410 nt, Artificial Sequence; identical to SEQ ID NO: 108250
  derived and/or modified sequence opt2 from neuraminidase__InfluenzaA__ACV67194

SEQ ID NO: 108869 - RNA, 1410 nt, Artificial Sequence; identical to SEQ ID NO: 108250
  derived and/or modified sequence opt2 from neuraminidase__InfluenzaA__ACV67195

SEQ ID NO: 108870 - RNA, 1410 nt, Artificial Sequence; identical to SEQ ID NO: 108250
  derived and/or modified sequence opt2 from neuraminidase__InfluenzaA__ACV67196

SEQ ID NO: 108871 - RNA, 1410 nt, Artificial Sequence; identical to SEQ ID NO: 108240
  derived and/or modified sequence opt2 from neuraminidase__InfluenzaA__ACV67197

SEQ ID NO: 108872 - RNA, 1410 nt, Artificial Sequence; identical to SEQ ID NO: 108240
  derived and/or modified sequence opt2 from neuraminidase__InfluenzaA__ACV67199

SEQ ID NO: 108873 - RNA, 1410 nt, Artificial Sequence; identical to SEQ ID NO: 108240
  derived and/or modified sequence opt2 from neuraminidase__InfluenzaA__ACV67200

SEQ ID NO: 108874 - RNA, 1410 nt, Artificial Sequence; identical to SEQ ID NO: 108240
  derived and/or modified sequence opt2 from neuraminidase__InfluenzaA__ACV67201

SEQ ID NO: 108875 - RNA, 1410 nt, Artificial Sequence; identical to SEQ ID NO: 108240
  derived and/or modified sequence opt2 from neuraminidase__InfluenzaA__ACV67202

SEQ ID NO: 108876 - RNA, 1410 nt, Artificial Sequence; identical to SEQ ID NO: 108250
  derived and/or modified sequence opt2 from neuraminidase__InfluenzaA__ACV67203

SEQ ID NO: 108877 - RNA, 1410 nt, Artificial Sequence; identical to SEQ ID NO: 108250
  derived and/or modified sequence opt2 from neuraminidase__InfluenzaA__ACV67204

SEQ ID NO: 108878 - RNA, 1410 nt, Artificial Sequence; identical to SEQ ID NO: 108250
  derived and/or modified sequence opt2 from neuraminidase__InfluenzaA__ACV67205

SEQ ID NO: 108879 - RNA, 1410 nt, Artificial Sequence
  derived and/or modified sequence opt2 from neuraminidase__InfluenzaA__ACV67206
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccauggucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108880 - RNA, 1410 nt, Artificial Sequence; identical to SEQ ID NO: 108240
  derived and/or modified sequence opt2 from neuraminidase__InfluenzaA__ACV67207

SEQ ID NO: 108881 - RNA, 1410 nt, Artificial Sequence; identical to SEQ ID NO: 108250
  derived and/or modified sequence opt2 from neuraminidase__InfluenzaA__ACV67208

SEQ ID NO: 108882 - RNA, 1410 nt, Artificial Sequence; identical to SEQ ID NO: 108240
  derived and/or modified sequence opt2 from neuraminidase__InfluenzaA__ACV67210

SEQ ID NO: 108883 - RNA, 1410 nt, Artificial Sequence; identical to SEQ ID NO: 108250
  derived and/or modified sequence opt2 from neuraminidase__InfluenzaA__ACV67211

SEQ ID NO: 108884 - RNA, 1410 nt, Artificial Sequence; identical to SEQ ID NO: 108250
  derived and/or modified sequence opt2 from neuraminidase__InfluenzaA__ACV70076

SEQ ID NO: 108885 - RNA, 1410 nt, Artificial Sequence
  derived and/or modified sequence opt2 from neuraminidase__InfluenzaA__ACV70086
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108886 - RNA, 1410 nt, Artificial Sequence
  derived and/or modified sequence opt2 from neuraminidase__InfluenzaA__ACV70096
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucaccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108887 - RNA, 1410 nt, Artificial Sequence; identical to SEQ ID NO: 108250
  derived and/or modified sequence opt2 from neuraminidase__InfluenzaA__ACV70106

SEQ ID NO: 108888 - RNA, 1410 nt, Artificial Sequence; identical to SEQ ID NO: 108250
  derived and/or modified sequence opt2 from neuraminidase__InfluenzaA__ACV70116

SEQ ID NO: 108889 - RNA, 1410 nt, Artificial Sequence; identical to SEQ ID NO: 108250
  derived and/or modified sequence opt2 from neuraminidase__InfluenzaA__ACV70126

SEQ ID NO: 108890 - RNA, 1410 nt, Artificial Sequence; identical to SEQ ID NO: 108250
  derived and/or modified sequence opt2 from neuraminidase__InfluenzaA__ACV70157

SEQ ID NO: 108891 - RNA, 1410 nt, Artificial Sequence; identical to SEQ ID NO: 108240
  derived and/or modified sequence opt2 from neuraminidase__InfluenzaA__ACV70167

SEQ ID NO: 108892 - RNA, 1410 nt, Artificial Sequence; identical to SEQ ID NO: 108250
  derived and/or modified sequence opt2 from neuraminidase__InfluenzaA__ACV70177

SEQ ID NO: 108893 - RNA, 1410 nt, Artificial Sequence; identical to SEQ ID NO: 108250
  derived and/or modified sequence opt2 from neuraminidase__InfluenzaA__ACV70187

SEQ ID NO: 108894 - RNA, 1410 nt, Artificial Sequence; identical to SEQ ID NO: 108250
  derived and/or modified sequence opt2 from neuraminidase__InfluenzaA__ACV70197

SEQ ID NO: 108895 - RNA, 1410 nt, Artificial Sequence; identical to SEQ ID NO: 108250
  derived and/or modified sequence opt2 from neuraminidase__InfluenzaA__ACV70207

SEQ ID NO: 108896 - RNA, 1410 nt, Artificial Sequence
  derived and/or modified sequence opt2 from neuraminidase__InfluenzaA__ACV70217
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108897 - RNA, 1410 nt, Artificial Sequence; identical to SEQ ID NO: 108250
  derived and/or modified sequence opt2 from neuraminidase__InfluenzaA__ACV70227

SEQ ID NO: 108898 - RNA, 1410 nt, Artificial Sequence; identical to SEQ ID NO: 108250
  derived and/or modified sequence opt2 from neuraminidase__InfluenzaA__ACV70237

SEQ ID NO: 108899 - RNA, 1410 nt, Artificial Sequence; identical to SEQ ID NO: 108250
  derived and/or modified sequence opt2 from neuraminidase__InfluenzaA__ACV70247

SEQ ID NO: 108900 - RNA, 1410 nt, Artificial Sequence; identical to SEQ ID NO: 108250
  derived and/or modified sequence opt2 from neuraminidase__InfluenzaA__ACV70257

SEQ ID NO: 108901 - RNA, 1410 nt, Artificial Sequence; identical to SEQ ID NO: 108250
  derived and/or modified sequence opt2 from neuraminidase__InfluenzaA__ACV70267

SEQ ID NO: 108902 - RNA, 1410 nt, Artificial Sequence; identical to SEQ ID NO: 108250
  derived and/or modified sequence opt2 from neuraminidase__InfluenzaA__ACV70277

SEQ ID NO: 108903 - RNA, 1410 nt, Artificial Sequence; identical to SEQ ID NO: 108250
  derived and/or modified sequence opt2 from neuraminidase__InfluenzaA__ACV70287

SEQ ID NO: 108904 - RNA, 1410 nt, Artificial Sequence; identical to SEQ ID NO: 108250
  derived and/or modified sequence opt2 from neuraminidase__InfluenzaA__ACV70297

SEQ ID NO: 108905 - RNA, 1410 nt, Artificial Sequence; identical to SEQ ID NO: 108250
  derived and/or modified sequence opt2 from neuraminidase__InfluenzaA__ACV70307

SEQ ID NO: 108906 - RNA, 1410 nt, Artificial Sequence; identical to SEQ ID NO: 108240
  derived and/or modified sequence opt2 from neuraminidase__InfluenzaA__ACV70317

SEQ ID NO: 108907 - RNA, 1410 nt, Artificial Sequence; identical to SEQ ID NO: 108250
  derived and/or modified sequence opt2 from neuraminidase__InfluenzaA__ACV70327

SEQ ID NO: 108908 - RNA, 1410 nt, Artificial Sequence; identical to SEQ ID NO: 108250
  derived and/or modified sequence opt2 from neuraminidase__InfluenzaA__ACV70337

SEQ ID NO: 108909 - RNA, 1410 nt, Artificial Sequence; identical to SEQ ID NO: 108250
  derived and/or modified sequence opt2 from neuraminidase__InfluenzaA__ACV70347

SEQ ID NO: 108910 - RNA, 1410 nt, Artificial Sequence; identical to SEQ ID NO: 108250
  derived and/or modified sequence opt2 from neuraminidase__InfluenzaA__ACV70357

SEQ ID NO: 108911 - RNA, 1410 nt, Artificial Sequence; identical to SEQ ID NO: 108250
  derived and/or modified sequence opt2 from neuraminidase__InfluenzaA__ACV70367

SEQ ID NO: 108912 - RNA, 1410 nt, Artificial Sequence; identical to SEQ ID NO: 108250
  derived and/or modified sequence opt2 from neuraminidase__InfluenzaA__ACV70377

SEQ ID NO: 108913 - RNA, 1410 nt, Artificial Sequence; identical to SEQ ID NO: 108250
  derived and/or modified sequence opt2 from neuraminidase__InfluenzaA__ACV70387

SEQ ID NO: 108914 - RNA, 1410 nt, Artificial Sequence; identical to SEQ ID NO: 108250
  derived and/or modified sequence opt2 from neuraminidase__InfluenzaA__ACV70397

SEQ ID NO: 108915 - RNA, 1410 nt, Artificial Sequence; identical to SEQ ID NO: 108250
  derived and/or modified sequence opt2 from neuraminidase__InfluenzaA__ACV70407

SEQ ID NO: 108916 - RNA, 1410 nt, Artificial Sequence; identical to SEQ ID NO: 108240
  derived and/or modified sequence opt2 from neuraminidase__InfluenzaA__ACV70417

SEQ ID NO: 108917 - RNA, 1410 nt, Artificial Sequence; identical to SEQ ID NO: 108250
  derived and/or modified sequence opt2 from neuraminidase__InfluenzaA__ACV70427

SEQ ID NO: 108918 - RNA, 1410 nt, Artificial Sequence; identical to SEQ ID NO: 108250
  derived and/or modified sequence opt2 from neuraminidase__InfluenzaA__ACV70437

SEQ ID NO: 108919 - RNA, 1410 nt, Artificial Sequence; identical to SEQ ID NO: 108250
  derived and/or modified sequence opt2 from neuraminidase__InfluenzaA__ACV70447

SEQ ID NO: 108920 - RNA, 1410 nt, Artificial Sequence; identical to SEQ ID NO: 108250
  derived and/or modified sequence opt2 from neuraminidase__InfluenzaA__ACV70457

SEQ ID NO: 108921 - RNA, 1410 nt, Artificial Sequence; identical to SEQ ID NO: 108250
  derived and/or modified sequence opt2 from neuraminidase__InfluenzaA__ACV70467

SEQ ID NO: 108922 - RNA, 1410 nt, Artificial Sequence; identical to SEQ ID NO: 108250
  derived and/or modified sequence opt2 from neuraminidase__InfluenzaA__ACV70477

SEQ ID NO: 108923 - RNA, 1410 nt, Artificial Sequence; identical to SEQ ID NO: 108250
  derived and/or modified sequence opt2 from neuraminidase__InfluenzaA__ACV70487

SEQ ID NO: 108924 - RNA, 1410 nt, Artificial Sequence; identical to SEQ ID NO: 108250
  derived and/or modified sequence opt2 from neuraminidase__InfluenzaA__ACV70497

SEQ ID NO: 108925 - RNA, 1410 nt, Artificial Sequence; identical to SEQ ID NO: 108250
  derived and/or modified sequence opt2 from neuraminidase__InfluenzaA__ACV70507

SEQ ID NO: 108926 - RNA, 1410 nt, Artificial Sequence; identical to SEQ ID NO: 108250
  derived and/or modified sequence opt2 from neuraminidase__InfluenzaA__ACV70517

SEQ ID NO: 108927 - RNA, 1410 nt, Artificial Sequence; identical to SEQ ID NO: 108250
  derived and/or modified sequence opt2 from neuraminidase__InfluenzaA__ACV70527

SEQ ID NO: 108928 - RNA, 1410 nt, Artificial Sequence; identical to SEQ ID NO: 108250
  derived and/or modified sequence opt2 from neuraminidase__InfluenzaA__ACV70547

SEQ ID NO: 108929 - RNA, 1410 nt, Artificial Sequence; identical to SEQ ID NO: 108250
  derived and/or modified sequence opt2 from neuraminidase__InfluenzaA__ACV70557

SEQ ID NO: 108930 - RNA, 1410 nt, Artificial Sequence; identical to SEQ ID NO: 108250
  derived and/or modified sequence opt2 from neuraminidase__InfluenzaA__ACV70567

SEQ ID NO: 108931 - RNA, 1410 nt, Artificial Sequence; identical to SEQ ID NO: 108250
  derived and/or modified sequence opt2 from neuraminidase__InfluenzaA__ACV70577

SEQ ID NO: 108932 - RNA, 1410 nt, Artificial Sequence; identical to SEQ ID NO: 108250
  derived and/or modified sequence opt2 from neuraminidase__InfluenzaA__ACV70587

SEQ ID NO: 108933 - RNA, 1410 nt, Artificial Sequence; identical to SEQ ID NO: 108240
  derived and/or modified sequence opt2 from neuraminidase__InfluenzaA__ACV70597

SEQ ID NO: 108934 - RNA, 1410 nt, Artificial Sequence; identical to SEQ ID NO: 108250
  derived and/or modified sequence opt2 from neuraminidase__InfluenzaA__ACV70607

SEQ ID NO: 108935 - RNA, 1410 nt, Artificial Sequence; identical to SEQ ID NO: 108833
  derived and/or modified sequence opt2 from neuraminidase__InfluenzaA__ACV70617

SEQ ID NO: 108936 - RNA, 1410 nt, Artificial Sequence; identical to SEQ ID NO: 108250
  derived and/or modified sequence opt2 from neuraminidase__InfluenzaA__ACV70647

SEQ ID NO: 108937 - RNA, 1410 nt, Artificial Sequence; identical to SEQ ID NO: 108250
  derived and/or modified sequence opt2 from neuraminidase__InfluenzaA__ACV70657

SEQ ID NO: 108938 - RNA, 1410 nt, Artificial Sequence; identical to SEQ ID NO: 108250
  derived and/or modified sequence opt2 from neuraminidase__InfluenzaA__ACV70667

SEQ ID NO: 108939 - RNA, 1410 nt, Artificial Sequence; identical to SEQ ID NO: 108250
  derived and/or modified sequence opt2 from neuraminidase__InfluenzaA__ACV70677

SEQ ID NO: 108940 - RNA, 1410 nt, Artificial Sequence; identical to SEQ ID NO: 108250
  derived and/or modified sequence opt2 from neuraminidase__InfluenzaA__ACV70687

SEQ ID NO: 108941 - RNA, 1410 nt, Artificial Sequence; identical to SEQ ID NO: 108250
  derived and/or modified sequence opt2 from neuraminidase__InfluenzaA__ACV70697

SEQ ID NO: 108942 - RNA, 1410 nt, Artificial Sequence; identical to SEQ ID NO: 108250
  derived and/or modified sequence opt2 from neuraminidase__InfluenzaA__ACV70707

SEQ ID NO: 108943 - RNA, 1410 nt, Artificial Sequence; identical to SEQ ID NO: 108250
  derived and/or modified sequence opt2 from neuraminidase__InfluenzaA__ACV70717

SEQ ID NO: 108944 - RNA, 1410 nt, Artificial Sequence; identical to SEQ ID NO: 108250
  derived and/or modified sequence opt2 from neuraminidase__InfluenzaA__ACV70727

SEQ ID NO: 108945 - RNA, 1410 nt, Artificial Sequence; identical to SEQ ID NO: 108250
  derived and/or modified sequence opt2 from neuraminidase__InfluenzaA__ACV70737

SEQ ID NO: 108946 - RNA, 1410 nt, Artificial Sequence; identical to SEQ ID NO: 108250
  derived and/or modified sequence opt2 from neuraminidase__InfluenzaA__ACV70757

SEQ ID NO: 108947 - RNA, 1410 nt, Artificial Sequence; identical to SEQ ID NO: 108250
  derived and/or modified sequence opt2 from neuraminidase__InfluenzaA__ACV70767

SEQ ID NO: 108948 - RNA, 1410 nt, Artificial Sequence; identical to SEQ ID NO: 108250
  derived and/or modified sequence opt2 from neuraminidase__InfluenzaA__ACV70777

SEQ ID NO: 108949 - RNA, 1410 nt, Artificial Sequence; identical to SEQ ID NO: 108250
  derived and/or modified sequence opt2 from neuraminidase__InfluenzaA__ACV70787

SEQ ID NO: 108950 - RNA, 1410 nt, Artificial Sequence; identical to SEQ ID NO: 108250
  derived and/or modified sequence opt2 from neuraminidase__InfluenzaA__ACV70797

SEQ ID NO: 108951 - RNA, 1410 nt, Artificial Sequence; identical to SEQ ID NO: 108250
  derived and/or modified sequence opt2 from neuraminidase__InfluenzaA__ACV70807

SEQ ID NO: 108952 - RNA, 1410 nt, Artificial Sequence; identical to SEQ ID NO: 108250
  derived and/or modified sequence opt2 from neuraminidase__InfluenzaA__ACV70817

SEQ ID NO: 108953 - RNA, 1410 nt, Artificial Sequence; identical to SEQ ID NO: 108240
  derived and/or modified sequence opt2 from neuraminidase__InfluenzaA__ACV70827

SEQ ID NO: 108954 - RNA, 1410 nt, Artificial Sequence; identical to SEQ ID NO: 108250
  derived and/or modified sequence opt2 from neuraminidase__InfluenzaA__ACV70837

SEQ ID NO: 108955 - RNA, 1410 nt, Artificial Sequence
  derived and/or modified sequence opt2 from neuraminidase__InfluenzaA__ACV70847
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucauguccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108956 - RNA, 1410 nt, Artificial Sequence; identical to SEQ ID NO: 108250
  derived and/or modified sequence opt2 from neuraminidase__InfluenzaA__ACV70867

SEQ ID NO: 108957 - RNA, 1410 nt, Artificial Sequence; identical to SEQ ID NO: 108250
  derived and/or modified sequence opt2 from neuraminidase__InfluenzaA__ACV70877

SEQ ID NO: 108958 - RNA, 1410 nt, Artificial Sequence
  derived and/or modified sequence opt2 from neuraminidase__InfluenzaA__ACV70887
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccauggucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108959 - RNA, 1410 nt, Artificial Sequence; identical to SEQ ID NO: 108250
  derived and/or modified sequence opt2 from neuraminidase__InfluenzaA__ACV70897

SEQ ID NO: 108960 - RNA, 1410 nt, Artificial Sequence; identical to SEQ ID NO: 108250
  derived and/or modified sequence opt2 from neuraminidase__InfluenzaA__ACV70907

SEQ ID NO: 108961 - RNA, 1410 nt, Artificial Sequence; identical to SEQ ID NO: 108250
  derived and/or modified sequence opt2 from neuraminidase__InfluenzaA__ACV70917

SEQ ID NO: 108962 - RNA, 1410 nt, Artificial Sequence; identical to SEQ ID NO: 108240
  derived and/or modified sequence opt2 from neuraminidase__InfluenzaA__ACV70927

SEQ ID NO: 108963 - RNA, 1410 nt, Artificial Sequence; identical to SEQ ID NO: 108250
  derived and/or modified sequence opt2 from neuraminidase__InfluenzaA__ACV70937

SEQ ID NO: 108964 - RNA, 1410 nt, Artificial Sequence; identical to SEQ ID NO: 108250
  derived and/or modified sequence opt2 from neuraminidase__InfluenzaA__ACV70947

SEQ ID NO: 108965 - RNA, 1410 nt, Artificial Sequence; identical to SEQ ID NO: 108250
  derived and/or modified sequence opt2 from neuraminidase__InfluenzaA__ACV70957

SEQ ID NO: 108966 - RNA, 1410 nt, Artificial Sequence; identical to SEQ ID NO: 108250
  derived and/or modified sequence opt2 from neuraminidase__InfluenzaA__ACV70967

SEQ ID NO: 108967 - RNA, 1410 nt, Artificial Sequence; identical to SEQ ID NO: 108250
  derived and/or modified sequence opt2 from neuraminidase__InfluenzaA__ACV70977

SEQ ID NO: 108968 - RNA, 1410 nt, Artificial Sequence; identical to SEQ ID NO: 108250
  derived and/or modified sequence opt2 from neuraminidase__InfluenzaA__ACV70987

SEQ ID NO: 108969 - RNA, 1410 nt, Artificial Sequence; identical to SEQ ID NO: 108250
  derived and/or modified sequence opt2 from neuraminidase__InfluenzaA__ACV71007

SEQ ID NO: 108970 - RNA, 1410 nt, Artificial Sequence; identical to SEQ ID NO: 108111
  derived and/or modified sequence opt2 from neuraminidase__InfluenzaA__ACV82218

SEQ ID NO: 108971 - RNA, 1410 nt, Artificial Sequence; identical to SEQ ID NO: 108111
  derived and/or modified sequence opt2 from neuraminidase__InfluenzaA__ACV82219

SEQ ID NO: 108972 - RNA, 1410 nt, Artificial Sequence
  derived and/or modified sequence opt2 from neuraminidase__InfluenzaA__ACV82220
augaaccccaaccagaagaucaucaccaucggcuccgucucccucaccaucuccaccaucugcuucuucaugcagcucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuacuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggagaagaccgagguccucuggaccuccaacuccaucgucgucuucugcggcaccuccggcaccuacggcaccggcuccuggcccgacggcgccgacaucaaccucaugcccaucuga

SEQ ID NO: 108973 - RNA, 1413 nt, Artificial Sequence
  derived and/or modified sequence opt2 from neuraminidase__InfluenzaA__ACV82221
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 108974 - RNA, 1410 nt, Artificial Sequence; identical to SEQ ID NO: 108250
  derived and/or modified sequence opt2 from neuraminidase__InfluenzaA__ACV88402

SEQ ID NO: 108975 - RNA, 1410 nt, Artificial Sequence; identical to SEQ ID NO: 108250
  derived and/or modified sequence opt2 from neuraminidase__InfluenzaA__ACV88412

SEQ ID NO: 108976 - RNA, 1410 nt, Artificial Sequence; identical to SEQ ID NO: 108240
  derived and/or modified sequence opt2 from neuraminidase__InfluenzaA__ACV88422

SEQ ID NO: 108977 - RNA, 1365 nt, Artificial Sequence
  derived and/or modified sequence opt2 from neuraminidase__InfluenzaA__ACV89505
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagggcaccaucuggaccuccgccuccuccaucuccuucugcggcgucaacuccgacaccgucgacugguccuggcccgacggcgccgagcuccccuucuccaucgacaaguga

SEQ ID NO: 108978 - RNA, 1410 nt, Artificial Sequence; identical to SEQ ID NO: 108250
  derived and/or modified sequence opt2 from neuraminidase__InfluenzaA__ACV91673

SEQ ID NO: 108979 - RNA, 1410 nt, Artificial Sequence; identical to SEQ ID NO: 108250
  derived and/or modified sequence opt2 from neuraminidase__InfluenzaA__ACV91681

SEQ ID NO: 108980 - RNA, 1410 nt, Artificial Sequence
  derived and/or modified sequence opt2 from neuraminidase__InfluenzaA__ACX31593
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccagguccuccucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 108981 - RNA, 1410 nt, Artificial Sequence; identical to SEQ ID NO: 108250
  derived and/or modified sequence opt2 from neuraminidase__InfluenzaA__ACX31901

SEQ ID NO: 108982 - RNA, 1410 nt, Artificial Sequence; identical to SEQ ID NO: 108250
  derived and/or modified sequence opt2 from neuraminidase__InfluenzaA__ACX31902

SEQ ID NO: 108983 - RNA, 1410 nt, Artificial Sequence; identical to SEQ ID NO: 108250
  derived and/or modified sequence opt2 from neuraminidase__InfluenzaA__ACX31905

SEQ ID NO: 108984 - RNA, 1410 nt, Artificial Sequence; identical to SEQ ID NO: 108250
  derived and/or modified sequence opt2 from neuraminidase__InfluenzaA__ACX31906

SEQ ID NO: 108985 - RNA, 1410 nt, Artificial Sequence; identical to SEQ ID NO: 108250
  derived and/or modified sequence opt2 from neuraminidase__InfluenzaA__ACX31907

SEQ ID NO: 108986 - RNA, 1410 nt, Artificial Sequence; identical to SEQ ID NO: 108250
  derived and/or modified sequence opt2 from neuraminidase__InfluenzaA__ACX31908

SEQ ID NO: 108987 - RNA, 1410 nt, Artificial Sequence; identical to SEQ ID NO: 108405
  derived and/or modified sequence opt2 from neuraminidase__InfluenzaA__ACX31909

SEQ ID NO: 108988 - RNA, 1410 nt, Artificial Sequence; identical to SEQ ID NO: 108250
  derived and/or modified sequence opt2 from neuraminidase__InfluenzaA__ACX31911

SEQ ID NO: 108989 - RNA, 1410 nt, Artificial Sequence; identical to SEQ ID NO: 108250
  derived and/or modified sequence opt2 from neuraminidase__InfluenzaA__ACX31912

SEQ ID NO: 108990 - RNA, 1410 nt, Artificial Sequence; identical to SEQ ID NO: 108250
  derived and/or modified sequence opt2 from neuraminidase__InfluenzaA__ACX31913

SEQ ID NO: 108991 - RNA, 1410 nt, Artificial Sequence; identical to SEQ ID NO: 108250
  derived and/or modified sequence opt2 from neuraminidase__InfluenzaA__ACX31914

SEQ ID NO: 108992 - RNA, 1410 nt, Artificial Sequence; identical to SEQ ID NO: 108250
  derived and/or modified sequence opt2 from neuraminidase__InfluenzaA__ACX31915

SEQ ID NO: 108993 - RNA, 1410 nt, Artificial Sequence; identical to SEQ ID NO: 108250
  derived and/or modified sequence opt2 from neuraminidase__InfluenzaA__ACX31916

SEQ ID NO: 108994 - RNA, 1410 nt, Artificial Sequence
  derived and/or modified sequence opt2 from neuraminidase__InfluenzaA__ACX31917
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaccgaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 108995 - RNA, 1410 nt, Artificial Sequence; identical to SEQ ID NO: 108250
  derived and/or modified sequence opt2 from neuraminidase__InfluenzaA__ACX31918

SEQ ID NO: 108996 - RNA, 1410 nt, Artificial Sequence; identical to SEQ ID NO: 108250
  derived and/or modified sequence opt2 from neuraminidase__InfluenzaA__ACX31919

SEQ ID NO: 108997 - RNA, 1410 nt, Artificial Sequence; identical to SEQ ID NO: 108250
  derived and/or modified sequence opt2 from neuraminidase__InfluenzaA__ACX31920

SEQ ID NO: 108998 - RNA, 1410 nt, Artificial Sequence; identical to SEQ ID NO: 108604
  derived and/or modified sequence opt2 from neuraminidase__InfluenzaA__ACX31922

SEQ ID NO: 108999 - RNA, 1410 nt, Artificial Sequence; identical to SEQ ID NO: 108250
  derived and/or modified sequence opt2 from neuraminidase__InfluenzaA__ACX31923

SEQ ID NO: 109000 - RNA, 1410 nt, Artificial Sequence; identical to SEQ ID NO: 108240
  derived and/or modified sequence opt2 from neuraminidase__InfluenzaA__ACX31924

SEQ ID NO: 109001 - RNA, 1410 nt, Artificial Sequence
  derived and/or modified sequence opt2 from neuraminidase__InfluenzaA__ACX31925
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucacccucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaucaucgacaaguga

SEQ ID NO: 109002 - RNA, 1410 nt, Artificial Sequence; identical to SEQ ID NO: 108250
  derived and/or modified sequence opt2 from neuraminidase__InfluenzaA__ACX31926

SEQ ID NO: 109003 - RNA, 1410 nt, Artificial Sequence; identical to SEQ ID NO: 108250
  derived and/or modified sequence opt2 from neuraminidase__InfluenzaA__ACX31927

SEQ ID NO: 109004 - RNA, 1410 nt, Artificial Sequence
  derived and/or modified sequence opt2 from neuraminidase__InfluenzaA__ACX31928
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgagaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacggcgacaccgucggcugguccuggcccgacggcgccgagcuccccuucaccaucgacaaguga

SEQ ID NO: 109005 - RNA, 1410 nt, Artificial Sequence; identical to SEQ ID NO: 108280
  derived and/or modified sequence opt2 from neuraminidase__InfluenzaA__ACX31929

SEQ ID NO: 109006 - RNA, 1410 nt, Artificial Sequence; identical to SEQ ID NO: 108604
  derived and/or modified sequence opt2 from neuraminidase__InfluenzaA__ACX31930

SEQ ID NO: 109007 - RNA, 1410 nt, Artificial Sequence; identical to SEQ ID NO: 108250
  derived and/or modified sequence opt2 from neuraminidase__InfluenzaA__ACX31931

SEQ ID NO: 109008 - RNA, 1410 nt, Artificial Sequence; identical to SEQ ID NO: 108250
  derived and/or modified sequence opt2 from neuraminidase__InfluenzaA__ACX31932

SEQ ID NO: 109009 - RNA, 1410 nt, Artificial Sequence; identical to SEQ ID NO: 108250
  derived and/or modified sequence opt2 from neuraminidase__InfluenzaA__ACX35250

SEQ ID NO: 109010 - RNA, 1410 nt, Artificial Sequence; identical to SEQ ID NO: 108250
  derived and/or modified sequence opt2 from neuraminidase__InfluenzaA__ACX35260

SEQ ID NO: 109011 - RNA, 1410 nt, Artificial Sequence; identical to SEQ ID NO: 108250
  derived and/or modified sequence opt2 from neuraminidase__InfluenzaA__ACX35270

SEQ ID NO: 109012 - RNA, 1410 nt, Artificial Sequence
  derived and/or modified sequence opt2 from neuraminidase__InfluenzaA__ACX35280
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgacaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109013 - RNA, 1410 nt, Artificial Sequence; identical to SEQ ID NO: 108250
  derived and/or modified sequence opt2 from neuraminidase__InfluenzaA__ACX35290

SEQ ID NO: 109014 - RNA, 1410 nt, Artificial Sequence; identical to SEQ ID NO: 108250
  derived and/or modified sequence opt2 from neuraminidase__InfluenzaA__ACX35300

SEQ ID NO: 109015 - RNA, 1410 nt, Artificial Sequence
  derived and/or modified sequence opt2 from neuraminidase__InfluenzaA__ACX35310
augaaccccaaccagaagaucaucaccaucggcuccgucugcaugaccaucggcauggccaaccucauccuccagaucggcaacaucaucuccaucuggaucucccacuccauccagcucggcaaccagaaccagaucggcaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109016 - RNA, 1410 nt, Artificial Sequence; identical to SEQ ID NO: 108250
  derived and/or modified sequence opt2 from neuraminidase__InfluenzaA__ACX35320

SEQ ID NO: 109017 - RNA, 1410 nt, Artificial Sequence
  derived and/or modified sequence opt2 from neuraminidase__InfluenzaA__ACX35330
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109018 - RNA, 1410 nt, Artificial Sequence; identical to SEQ ID NO: 108250
  derived and/or modified sequence opt2 from neuraminidase__InfluenzaA__ACX48479

SEQ ID NO: 109019 - RNA, 1410 nt, Artificial Sequence; identical to SEQ ID NO: 108250
  derived and/or modified sequence opt2 from neuraminidase__InfluenzaA__ACX48481

SEQ ID NO: 109020 - RNA, 1410 nt, Artificial Sequence; identical to SEQ ID NO: 108250
  derived and/or modified sequence opt2 from neuraminidase__InfluenzaA__ACX55836

SEQ ID NO: 109021 - RNA, 1410 nt, Artificial Sequence
  derived and/or modified sequence opt2 from neuraminidase__InfluenzaA__ACX56269
augaaccccaagcagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109022 - RNA, 1410 nt, Artificial Sequence
  derived and/or modified sequence opt2 from neuraminidase__InfluenzaA__ACX56270
augaaccccaagcagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacuccgucuccugguccuggcccgacggcgccgagcuccccuucaccaucgacaaguga

SEQ ID NO: 109023 - RNA, 1410 nt, Artificial Sequence
  derived and/or modified sequence opt2 from neuraminidase__InfluenzaA__ACX56271
augaaccccaagcagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaaccucgccgccggccaguccgucggcuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109024 - RNA, 1410 nt, Artificial Sequence; identical to SEQ ID NO: 108250
  derived and/or modified sequence opt2 from neuraminidase__InfluenzaA__ACX83579

SEQ ID NO: 109025 - RNA, 1410 nt, Artificial Sequence; identical to SEQ ID NO: 108250
  derived and/or modified sequence opt2 from neuraminidase__InfluenzaA__ACX85425

SEQ ID NO: 109026 - RNA, 1410 nt, Artificial Sequence; identical to SEQ ID NO: 108250
  derived and/or modified sequence opt2 from neuraminidase__InfluenzaA__ACX85426

SEQ ID NO: 109027 - RNA, 1410 nt, Artificial Sequence
  derived and/or modified sequence opt2 from neuraminidase__InfluenzaA__ACY02998
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109028 - RNA, 1410 nt, Artificial Sequence; identical to SEQ ID NO: 108250
  derived and/or modified sequence opt2 from neuraminidase__InfluenzaA__ACY03005

SEQ ID NO: 109029 - RNA, 1410 nt, Artificial Sequence; identical to SEQ ID NO: 108250
  derived and/or modified sequence opt2 from neuraminidase__InfluenzaA__ACY03008

SEQ ID NO: 109030 - RNA, 1410 nt, Artificial Sequence; identical to SEQ ID NO: 108250
  derived and/or modified sequence opt2 from neuraminidase__InfluenzaA__ACY03011

SEQ ID NO: 109031 - RNA, 1410 nt, Artificial Sequence; identical to SEQ ID NO: 108250
  derived and/or modified sequence opt2 from neuraminidase__InfluenzaA__ACY03012

SEQ ID NO: 109032 - RNA, 1410 nt, Artificial Sequence; identical to SEQ ID NO: 108250
  derived and/or modified sequence opt2 from neuraminidase__InfluenzaA__ACY03016

SEQ ID NO: 109033 - RNA, 1410 nt, Artificial Sequence; identical to SEQ ID NO: 108250
  derived and/or modified sequence opt2 from neuraminidase__InfluenzaA__ACY26194

SEQ ID NO: 109034 - RNA, 1410 nt, Artificial Sequence; identical to SEQ ID NO: 108250
  derived and/or modified sequence opt2 from neuraminidase__InfluenzaA__ACY26204

SEQ ID NO: 109035 - RNA, 1410 nt, Artificial Sequence; identical to SEQ ID NO: 108250
  derived and/or modified sequence opt2 from neuraminidase__InfluenzaA__ACY30123

SEQ ID NO: 109036 - RNA, 1410 nt, Artificial Sequence; identical to SEQ ID NO: 108250
  derived and/or modified sequence opt2 from neuraminidase__InfluenzaA__ACY30124

SEQ ID NO: 109037 - RNA, 1410 nt, Artificial Sequence; identical to SEQ ID NO: 108250
  derived and/or modified sequence opt2 from neuraminidase__InfluenzaA__ACY30125

SEQ ID NO: 109038 - RNA, 1410 nt, Artificial Sequence; identical to SEQ ID NO: 108250
  derived and/or modified sequence opt2 from neuraminidase__InfluenzaA__ACY30127

SEQ ID NO: 109039 - RNA, 1410 nt, Artificial Sequence; identical to SEQ ID NO: 108250
  derived and/or modified sequence opt2 from neuraminidase__InfluenzaA__ACY30128

SEQ ID NO: 109040 - RNA, 1410 nt, Artificial Sequence; identical to SEQ ID NO: 108250
  derived and/or modified sequence opt2 from neuraminidase__InfluenzaA__ACY46105

SEQ ID NO: 109041 - RNA, 1410 nt, Artificial Sequence; identical to SEQ ID NO: 108250
  derived and/or modified sequence opt2 from neuraminidase__InfluenzaA__ACY46165

SEQ ID NO: 109042 - RNA, 1410 nt, Artificial Sequence; identical to SEQ ID NO: 108250
  derived and/or modified sequence opt2 from neuraminidase__InfluenzaA__ACY46175

SEQ ID NO: 109043 - RNA, 1410 nt, Artificial Sequence; identical to SEQ ID NO: 108250
  derived and/or modified sequence opt2 from neuraminidase__InfluenzaA__ACY46345

SEQ ID NO: 109044 - RNA, 1410 nt, Artificial Sequence; identical to SEQ ID NO: 108250
  derived and/or modified sequence opt2 from neuraminidase__InfluenzaA__ACY46385

SEQ ID NO: 109045 - RNA, 1410 nt, Artificial Sequence; identical to SEQ ID NO: 108250
  derived and/or modified sequence opt2 from neuraminidase__InfluenzaA__ACY46485

SEQ ID NO: 109046 - RNA, 1410 nt, Artificial Sequence; identical to SEQ ID NO: 108280
  derived and/or modified sequence opt2 from neuraminidase__InfluenzaA__ACY77536

SEQ ID NO: 109047 - RNA, 1410 nt, Artificial Sequence; identical to SEQ ID NO: 108240
  derived and/or modified sequence opt2 from neuraminidase__InfluenzaA__ACY77546

SEQ ID NO: 109048 - RNA, 1410 nt, Artificial Sequence; identical to SEQ ID NO: 108280
  derived and/or modified sequence opt2 from neuraminidase__InfluenzaA__ACY77565

SEQ ID NO: 109049 - RNA, 1410 nt, Artificial Sequence
  derived and/or modified sequence opt2 from neuraminidase__InfluenzaA__ACY77575
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccuccgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109050 - RNA, 1410 nt, Artificial Sequence; identical to SEQ ID NO: 108250
  derived and/or modified sequence opt2 from neuraminidase__InfluenzaA__ACY77585

SEQ ID NO: 109051 - RNA, 1410 nt, Artificial Sequence; identical to SEQ ID NO: 108280
  derived and/or modified sequence opt2 from neuraminidase__InfluenzaA__ACY77595

SEQ ID NO: 109052 - RNA, 1410 nt, Artificial Sequence; identical to SEQ ID NO: 108280
  derived and/or modified sequence opt2 from neuraminidase__InfluenzaA__ACY77605

SEQ ID NO: 109053 - RNA, 1410 nt, Artificial Sequence; identical to SEQ ID NO: 108250
  derived and/or modified sequence opt2 from neuraminidase__InfluenzaA__ACY77625

SEQ ID NO: 109054 - RNA, 1410 nt, Artificial Sequence
  derived and/or modified sequence opt2 from neuraminidase__InfluenzaA__ACY77655
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuucaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109055 - RNA, 1410 nt, Artificial Sequence; identical to SEQ ID NO: 108250
  derived and/or modified sequence opt2 from neuraminidase__InfluenzaA__ACY77665

SEQ ID NO: 109056 - RNA, 1410 nt, Artificial Sequence; identical to SEQ ID NO: 108250
  derived and/or modified sequence opt2 from neuraminidase__InfluenzaA__ACY77675

SEQ ID NO: 109057 - RNA, 1410 nt, Artificial Sequence; identical to SEQ ID NO: 108240
  derived and/or modified sequence opt2 from neuraminidase__InfluenzaA__ACY77685

SEQ ID NO: 109058 - RNA, 1410 nt, Artificial Sequence; identical to SEQ ID NO: 108240
  derived and/or modified sequence opt2 from neuraminidase__InfluenzaA__ACY77695

SEQ ID NO: 109059 - RNA, 1410 nt, Artificial Sequence; identical to SEQ ID NO: 108240
  derived and/or modified sequence opt2 from neuraminidase__InfluenzaA__ACY77705

SEQ ID NO: 109060 - RNA, 1410 nt, Artificial Sequence; identical to SEQ ID NO: 108240
  derived and/or modified sequence opt2 from neuraminidase__InfluenzaA__ACY77725

SEQ ID NO: 109061 - RNA, 1410 nt, Artificial Sequence; identical to SEQ ID NO: 108240
  derived and/or modified sequence opt2 from neuraminidase__InfluenzaA__ACY77735

SEQ ID NO: 109062 - RNA, 1410 nt, Artificial Sequence; identical to SEQ ID NO: 108250
  derived and/or modified sequence opt2 from neuraminidase__InfluenzaA__ACY77745

SEQ ID NO: 109063 - RNA, 1410 nt, Artificial Sequence; identical to SEQ ID NO: 108250
  derived and/or modified sequence opt2 from neuraminidase__InfluenzaA__ACY77755

SEQ ID NO: 109064 - RNA, 1410 nt, Artificial Sequence; identical to SEQ ID NO: 108250
  derived and/or modified sequence opt2 from neuraminidase__InfluenzaA__ACY77775

SEQ ID NO: 109065 - RNA, 1410 nt, Artificial Sequence; identical to SEQ ID NO: 108250
  derived and/or modified sequence opt2 from neuraminidase__InfluenzaA__ACY77785

SEQ ID NO: 109066 - RNA, 1410 nt, Artificial Sequence; identical to SEQ ID NO: 108250
  derived and/or modified sequence opt2 from neuraminidase__InfluenzaA__ACY77795

SEQ ID NO: 109067 - RNA, 1410 nt, Artificial Sequence
  derived and/or modified sequence opt2 from neuraminidase__InfluenzaA__ACY77825
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109068 - RNA, 1410 nt, Artificial Sequence; identical to SEQ ID NO: 109067
  derived and/or modified sequence opt2 from neuraminidase__InfluenzaA__ACY77835

SEQ ID NO: 109069 - RNA, 1410 nt, Artificial Sequence; identical to SEQ ID NO: 108280
  derived and/or modified sequence opt2 from neuraminidase__InfluenzaA__ACY77845

SEQ ID NO: 109070 - RNA, 1410 nt, Artificial Sequence; identical to SEQ ID NO: 108250
  derived and/or modified sequence opt2 from neuraminidase__InfluenzaA__ACY77865

SEQ ID NO: 109071 - RNA, 1410 nt, Artificial Sequence
  derived and/or modified sequence opt2 from neuraminidase__InfluenzaA__ACY77870
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaaccucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109072 - RNA, 1410 nt, Artificial Sequence; identical to SEQ ID NO: 108250
  derived and/or modified sequence opt2 from neuraminidase__InfluenzaA__ACY77877

SEQ ID NO: 109073 - RNA, 1410 nt, Artificial Sequence; identical to SEQ ID NO: 108250
  derived and/or modified sequence opt2 from neuraminidase__InfluenzaA__ACY77887

SEQ ID NO: 109074 - RNA, 1410 nt, Artificial Sequence; identical to SEQ ID NO: 108250
  derived and/or modified sequence opt2 from neuraminidase__InfluenzaA__ACY77907

SEQ ID NO: 109075 - RNA, 1410 nt, Artificial Sequence; identical to SEQ ID NO: 108280
  derived and/or modified sequence opt2 from neuraminidase__InfluenzaA__ACY77917

SEQ ID NO: 109076 - RNA, 1410 nt, Artificial Sequence
  derived and/or modified sequence opt2 from neuraminidase__InfluenzaA__ACY77927
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccaacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109077 - RNA, 1410 nt, Artificial Sequence; identical to SEQ ID NO: 108250
  derived and/or modified sequence opt2 from neuraminidase__InfluenzaA__ACY77937

SEQ ID NO: 109078 - RNA, 1410 nt, Artificial Sequence; identical to SEQ ID NO: 108250
  derived and/or modified sequence opt2 from neuraminidase__InfluenzaA__ACY77947

SEQ ID NO: 109079 - RNA, 1410 nt, Artificial Sequence; identical to SEQ ID NO: 108250
  derived and/or modified sequence opt2 from neuraminidase__InfluenzaA__ACY77967

SEQ ID NO: 109080 - RNA, 1410 nt, Artificial Sequence; identical to SEQ ID NO: 108240
  derived and/or modified sequence opt2 from neuraminidase__InfluenzaA__ACY77977

SEQ ID NO: 109081 - RNA, 1410 nt, Artificial Sequence; identical to SEQ ID NO: 108250
  derived and/or modified sequence opt2 from neuraminidase__InfluenzaA__ACY77987

SEQ ID NO: 109082 - RNA, 1410 nt, Artificial Sequence
  derived and/or modified sequence opt2 from neuraminidase__InfluenzaA__ACY77997
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucacccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109083 - RNA, 1410 nt, Artificial Sequence; identical to SEQ ID NO: 108250
  derived and/or modified sequence opt2 from neuraminidase__InfluenzaA__ACY78017

SEQ ID NO: 109084 - RNA, 1410 nt, Artificial Sequence
  derived and/or modified sequence opt2 from neuraminidase__InfluenzaA__ACZ01955
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccggcaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109085 - RNA, 1410 nt, Artificial Sequence; identical to SEQ ID NO: 108250
  derived and/or modified sequence opt2 from neuraminidase__InfluenzaA__ACZ05053

SEQ ID NO: 109086 - RNA, 1410 nt, Artificial Sequence; identical to SEQ ID NO: 108240
  derived and/or modified sequence opt2 from neuraminidase__InfluenzaA__ACZ05064

SEQ ID NO: 109087 - RNA, 1410 nt, Artificial Sequence; identical to SEQ ID NO: 108250
  derived and/or modified sequence opt2 from neuraminidase__InfluenzaA__ACZ05074

SEQ ID NO: 109088 - RNA, 1410 nt, Artificial Sequence; identical to SEQ ID NO: 108250
  derived and/or modified sequence opt2 from neuraminidase__InfluenzaA__ACZ05084

SEQ ID NO: 109089 - RNA, 1410 nt, Artificial Sequence; identical to SEQ ID NO: 108250
  derived and/or modified sequence opt2 from neuraminidase__InfluenzaA__ACZ05094

SEQ ID NO: 109090 - RNA, 1410 nt, Artificial Sequence; identical to SEQ ID NO: 108250
  derived and/or modified sequence opt2 from neuraminidase__InfluenzaA__ACZ05104

SEQ ID NO: 109091 - RNA, 1410 nt, Artificial Sequence; identical to SEQ ID NO: 108250
  derived and/or modified sequence opt2 from neuraminidase__InfluenzaA__ACZ05114

SEQ ID NO: 109092 - RNA, 1410 nt, Artificial Sequence; identical to SEQ ID NO: 108250
  derived and/or modified sequence opt2 from neuraminidase__InfluenzaA__ACZ05124

SEQ ID NO: 109093 - RNA, 1410 nt, Artificial Sequence; identical to SEQ ID NO: 108250
  derived and/or modified sequence opt2 from neuraminidase__InfluenzaA__ACZ05144

SEQ ID NO: 109094 - RNA, 1410 nt, Artificial Sequence; identical to SEQ ID NO: 108250
  derived and/or modified sequence opt2 from neuraminidase__InfluenzaA__ACZ05154

SEQ ID NO: 109095 - RNA, 1410 nt, Artificial Sequence; identical to SEQ ID NO: 108111
  derived and/or modified sequence opt2 from neuraminidase__InfluenzaA__ACZ05164

SEQ ID NO: 109096 - RNA, 1410 nt, Artificial Sequence; identical to SEQ ID NO: 108111
  derived and/or modified sequence opt2 from neuraminidase__InfluenzaA__ACZ05175

SEQ ID NO: 109097 - RNA, 1413 nt, Artificial Sequence
  derived and/or modified sequence opt2 from neuraminidase__InfluenzaA__ACZ05197
augaaccccaaccagaagaucaugaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109098 - RNA, 1410 nt, Artificial Sequence
  derived and/or modified sequence opt2 from neuraminidase__InfluenzaA__ACZ05208
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugcuccgaccccaacaacgaggagggcggccacggcgucaagggcugggccuucgacuccggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109099 - RNA, 1410 nt, Artificial Sequence
  derived and/or modified sequence opt2 from neuraminidase__InfluenzaA__ACZ05219
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109100 - RNA, 1410 nt, Artificial Sequence; identical to SEQ ID NO: 108111
  derived and/or modified sequence opt2 from neuraminidase__InfluenzaA__ACZ05230

SEQ ID NO: 109101 - RNA, 1410 nt, Artificial Sequence
  derived and/or modified sequence opt2 from neuraminidase__InfluenzaA__ACZ05241
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109102 - RNA, 1413 nt, Artificial Sequence
  derived and/or modified sequence opt2 from neuraminidase__InfluenzaA__ACZ05296
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucgccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109103 - RNA, 1410 nt, Artificial Sequence; identical to SEQ ID NO: 108111
  derived and/or modified sequence opt2 from neuraminidase__InfluenzaA__ACZ05307

SEQ ID NO: 109104 - RNA, 1410 nt, Artificial Sequence
  derived and/or modified sequence opt2 from neuraminidase__InfluenzaA__ACZ05318
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109105 - RNA, 1410 nt, Artificial Sequence; identical to SEQ ID NO: 108111
  derived and/or modified sequence opt2 from neuraminidase__InfluenzaA__ACZ05329

SEQ ID NO: 109106 - RNA, 1410 nt, Artificial Sequence; identical to SEQ ID NO: 108024
  derived and/or modified sequence opt2 from neuraminidase__InfluenzaA__ACZ05340

SEQ ID NO: 109107 - RNA, 1410 nt, Artificial Sequence; identical to SEQ ID NO: 109101
  derived and/or modified sequence opt2 from neuraminidase__InfluenzaA__ACZ05362

SEQ ID NO: 109108 - RNA, 1410 nt, Artificial Sequence; identical to SEQ ID NO: 108111
  derived and/or modified sequence opt2 from neuraminidase__InfluenzaA__ACZ05373

SEQ ID NO: 109109 - RNA, 1410 nt, Artificial Sequence; identical to SEQ ID NO: 108111
  derived and/or modified sequence opt2 from neuraminidase__InfluenzaA__ACZ05395

SEQ ID NO: 109110 - RNA, 1410 nt, Artificial Sequence; identical to SEQ ID NO: 108111
  derived and/or modified sequence opt2 from neuraminidase__InfluenzaA__ACZ05406

SEQ ID NO: 109111 - RNA, 1413 nt, Artificial Sequence
  derived and/or modified sequence opt2 from neuraminidase__InfluenzaA__ACZ05450
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109112 - RNA, 1410 nt, Artificial Sequence; identical to SEQ ID NO: 108111
  derived and/or modified sequence opt2 from neuraminidase__InfluenzaA__ACZ05461

SEQ ID NO: 109113 - RNA, 1410 nt, Artificial Sequence; identical to SEQ ID NO: 108111
  derived and/or modified sequence opt2 from neuraminidase__InfluenzaA__ACZ05472

SEQ ID NO: 109114 - RNA, 1410 nt, Artificial Sequence
  derived and/or modified sequence opt2 from neuraminidase__InfluenzaA__ACZ05483
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccgucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109115 - RNA, 1410 nt, Artificial Sequence; identical to SEQ ID NO: 108111
  derived and/or modified sequence opt2 from neuraminidase__InfluenzaA__ACZ05494

SEQ ID NO: 109116 - RNA, 1410 nt, Artificial Sequence; identical to SEQ ID NO: 109104
  derived and/or modified sequence opt2 from neuraminidase__InfluenzaA__ACZ05516

SEQ ID NO: 109117 - RNA, 1410 nt, Artificial Sequence
  derived and/or modified sequence opt2 from neuraminidase__InfluenzaA__ACZ05527
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugcuccgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109118 - RNA, 1410 nt, Artificial Sequence; identical to SEQ ID NO: 109101
  derived and/or modified sequence opt2 from neuraminidase__InfluenzaA__ACZ05538

SEQ ID NO: 109119 - RNA, 1413 nt, Artificial Sequence; identical to SEQ ID NO: 108973
  derived and/or modified sequence opt2 from neuraminidase__InfluenzaA__ACZ05593

SEQ ID NO: 109120 - RNA, 1413 nt, Artificial Sequence
  derived and/or modified sequence opt2 from neuraminidase__InfluenzaA__ACZ05604
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccauccgcggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109121 - RNA, 1410 nt, Artificial Sequence; identical to SEQ ID NO: 108111
  derived and/or modified sequence opt2 from neuraminidase__InfluenzaA__ACZ05953

SEQ ID NO: 109122 - RNA, 1410 nt, Artificial Sequence; identical to SEQ ID NO: 109117
  derived and/or modified sequence opt2 from neuraminidase__InfluenzaA__ACZ05964

SEQ ID NO: 109123 - RNA, 1410 nt, Artificial Sequence; identical to SEQ ID NO: 108111
  derived and/or modified sequence opt2 from neuraminidase__InfluenzaA__ACZ05997

SEQ ID NO: 109124 - RNA, 1410 nt, Artificial Sequence; identical to SEQ ID NO: 109117
  derived and/or modified sequence opt2 from neuraminidase__InfluenzaA__ACZ06008

SEQ ID NO: 109125 - RNA, 1410 nt, Artificial Sequence; identical to SEQ ID NO: 109117
  derived and/or modified sequence opt2 from neuraminidase__InfluenzaA__ACZ06019

SEQ ID NO: 109126 - RNA, 1413 nt, Artificial Sequence
  derived and/or modified sequence opt2 from neuraminidase__InfluenzaA__ACZ16015
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucuccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109127 - RNA, 1413 nt, Artificial Sequence
  derived and/or modified sequence opt2 from neuraminidase__InfluenzaA__ACZ16025
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109128 - RNA, 1413 nt, Artificial Sequence; identical to SEQ ID NO: 108973
  derived and/or modified sequence opt2 from neuraminidase__InfluenzaA__ACZ16035

SEQ ID NO: 109129 - RNA, 1410 nt, Artificial Sequence
  derived and/or modified sequence opt2 from neuraminidase__InfluenzaA__ACZ16043
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacaacauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109130 - RNA, 1410 nt, Artificial Sequence
  derived and/or modified sequence opt2 from neuraminidase__InfluenzaA__ACZ16053
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaccaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109131 - RNA, 1410 nt, Artificial Sequence; identical to SEQ ID NO: 108240
  derived and/or modified sequence opt2 from neuraminidase__InfluenzaA__ACZ16073

SEQ ID NO: 109132 - RNA, 1410 nt, Artificial Sequence
  derived and/or modified sequence opt2 from neuraminidase__InfluenzaA__ACZ16083
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgcccgccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucggcugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucuggaucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109133 - RNA, 1410 nt, Artificial Sequence; identical to SEQ ID NO: 108240
  derived and/or modified sequence opt2 from neuraminidase__InfluenzaA__ACZ16093

SEQ ID NO: 109134 - RNA, 1410 nt, Artificial Sequence; identical to SEQ ID NO: 108250
  derived and/or modified sequence opt2 from neuraminidase__InfluenzaA__ACZ16103

SEQ ID NO: 109135 - RNA, 1410 nt, Artificial Sequence; identical to SEQ ID NO: 108250
  derived and/or modified sequence opt2 from neuraminidase__InfluenzaA__ACZ16113

SEQ ID NO: 109136 - RNA, 1410 nt, Artificial Sequence; identical to SEQ ID NO: 108250
  derived and/or modified sequence opt2 from neuraminidase__InfluenzaA__ACZ16123

SEQ ID NO: 109137 - RNA, 1410 nt, Artificial Sequence
  derived and/or modified sequence opt2 from neuraminidase__InfluenzaA__ACZ16133
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109138 - RNA, 1410 nt, Artificial Sequence
  derived and/or modified sequence opt2 from neuraminidase__InfluenzaA__ACZ16143
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggcccccucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109139 - RNA, 1410 nt, Artificial Sequence; identical to SEQ ID NO: 108250
  derived and/or modified sequence opt2 from neuraminidase__InfluenzaA__ACZ16153

SEQ ID NO: 109140 - RNA, 1410 nt, Artificial Sequence; identical to SEQ ID NO: 108250
  derived and/or modified sequence opt2 from neuraminidase__InfluenzaA__ACZ16163

SEQ ID NO: 109141 - RNA, 1410 nt, Artificial Sequence; identical to SEQ ID NO: 108240
  derived and/or modified sequence opt2 from neuraminidase__InfluenzaA__ACZ16173

SEQ ID NO: 109142 - RNA, 1410 nt, Artificial Sequence; identical to SEQ ID NO: 108250
  derived and/or modified sequence opt2 from neuraminidase__InfluenzaA__ACZ16193

SEQ ID NO: 109143 - RNA, 1410 nt, Artificial Sequence; identical to SEQ ID NO: 108250
  derived and/or modified sequence opt2 from neuraminidase__InfluenzaA__ACZ16203

SEQ ID NO: 109144 - RNA, 1410 nt, Artificial Sequence; identical to SEQ ID NO: 108250
  derived and/or modified sequence opt2 from neuraminidase__InfluenzaA__ACZ16213

SEQ ID NO: 109145 - RNA, 1410 nt, Artificial Sequence
  derived and/or modified sequence opt2 from neuraminidase__InfluenzaA__ACZ16223
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacgagaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109146 - RNA, 1410 nt, Artificial Sequence; identical to SEQ ID NO: 108250
  derived and/or modified sequence opt2 from neuraminidase__InfluenzaA__ACZ16233

SEQ ID NO: 109147 - RNA, 1410 nt, Artificial Sequence; identical to SEQ ID NO: 108958
  derived and/or modified sequence opt2 from neuraminidase__InfluenzaA__ACZ16243

SEQ ID NO: 109148 - RNA, 1410 nt, Artificial Sequence
  derived and/or modified sequence opt2 from neuraminidase__InfluenzaA__ACZ16253
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaacaucgacaaguga

SEQ ID NO: 109149 - RNA, 1410 nt, Artificial Sequence; identical to SEQ ID NO: 108250
  derived and/or modified sequence opt2 from neuraminidase__InfluenzaA__ACZ16263

SEQ ID NO: 109150 - RNA, 1410 nt, Artificial Sequence; identical to SEQ ID NO: 108240
  derived and/or modified sequence opt2 from neuraminidase__InfluenzaA__ACZ16283

SEQ ID NO: 109151 - RNA, 1410 nt, Artificial Sequence; identical to SEQ ID NO: 108250
  derived and/or modified sequence opt2 from neuraminidase__InfluenzaA__ACZ16293

SEQ ID NO: 109152 - RNA, 1410 nt, Artificial Sequence; identical to SEQ ID NO: 108250
  derived and/or modified sequence opt2 from neuraminidase__InfluenzaA__ACZ16303

SEQ ID NO: 109153 - RNA, 1410 nt, Artificial Sequence; identical to SEQ ID NO: 108250
  derived and/or modified sequence opt2 from neuraminidase__InfluenzaA__ACZ16313

SEQ ID NO: 109154 - RNA, 1410 nt, Artificial Sequence; identical to SEQ ID NO: 108250
  derived and/or modified sequence opt2 from neuraminidase__InfluenzaA__ACZ16323

SEQ ID NO: 109155 - RNA, 1410 nt, Artificial Sequence; identical to SEQ ID NO: 108250
  derived and/or modified sequence opt2 from neuraminidase__InfluenzaA__ACZ16333

SEQ ID NO: 109156 - RNA, 1410 nt, Artificial Sequence; identical to SEQ ID NO: 108958
  derived and/or modified sequence opt2 from neuraminidase__InfluenzaA__ACZ16343

SEQ ID NO: 109157 - RNA, 1410 nt, Artificial Sequence; identical to SEQ ID NO: 108250
  derived and/or modified sequence opt2 from neuraminidase__InfluenzaA__ACZ16353

SEQ ID NO: 109158 - RNA, 1410 nt, Artificial Sequence; identical to SEQ ID NO: 108250
  derived and/or modified sequence opt2 from neuraminidase__InfluenzaA__ACZ16363

SEQ ID NO: 109159 - RNA, 1410 nt, Artificial Sequence; identical to SEQ ID NO: 108240
  derived and/or modified sequence opt2 from neuraminidase__InfluenzaA__ACZ16373

SEQ ID NO: 109160 - RNA, 1410 nt, Artificial Sequence; identical to SEQ ID NO: 108250
  derived and/or modified sequence opt2 from neuraminidase__InfluenzaA__ACZ16383

SEQ ID NO: 109161 - RNA, 1410 nt, Artificial Sequence; identical to SEQ ID NO: 108250
  derived and/or modified sequence opt2 from neuraminidase__InfluenzaA__ACZ16393

SEQ ID NO: 109162 - RNA, 1410 nt, Artificial Sequence; identical to SEQ ID NO: 108250
  derived and/or modified sequence opt2 from neuraminidase__InfluenzaA__ACZ16403

SEQ ID NO: 109163 - RNA, 1410 nt, Artificial Sequence; identical to SEQ ID NO: 108250
  derived and/or modified sequence opt2 from neuraminidase__InfluenzaA__ACZ16423

SEQ ID NO: 109164 - RNA, 1410 nt, Artificial Sequence; identical to SEQ ID NO: 108250
  derived and/or modified sequence opt2 from neuraminidase__InfluenzaA__ACZ16433

SEQ ID NO: 109165 - RNA, 1410 nt, Artificial Sequence; identical to SEQ ID NO: 108250
  derived and/or modified sequence opt2 from neuraminidase__InfluenzaA__ACZ16443

SEQ ID NO: 109166 - RNA, 1410 nt, Artificial Sequence; identical to SEQ ID NO: 108250
  derived and/or modified sequence opt2 from neuraminidase__InfluenzaA__ACZ16453

SEQ ID NO: 109167 - RNA, 1410 nt, Artificial Sequence; identical to SEQ ID NO: 108958
  derived and/or modified sequence opt2 from neuraminidase__InfluenzaA__ACZ16463

SEQ ID NO: 109168 - RNA, 1410 nt, Artificial Sequence; identical to SEQ ID NO: 108250
  derived and/or modified sequence opt2 from neuraminidase__InfluenzaA__ACZ16483

SEQ ID NO: 109169 - RNA, 1410 nt, Artificial Sequence; identical to SEQ ID NO: 108250
  derived and/or modified sequence opt2 from neuraminidase__InfluenzaA__ACZ16493

SEQ ID NO: 109170 - RNA, 1410 nt, Artificial Sequence
  derived and/or modified sequence opt2 from neuraminidase__InfluenzaA__ACZ16503
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagauggacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109171 - RNA, 1410 nt, Artificial Sequence; identical to SEQ ID NO: 108958
  derived and/or modified sequence opt2 from neuraminidase__InfluenzaA__ACZ16513

SEQ ID NO: 109172 - RNA, 1410 nt, Artificial Sequence; identical to SEQ ID NO: 108250
  derived and/or modified sequence opt2 from neuraminidase__InfluenzaA__ACZ16523

SEQ ID NO: 109173 - RNA, 1410 nt, Artificial Sequence; identical to SEQ ID NO: 108250
  derived and/or modified sequence opt2 from neuraminidase__InfluenzaA__ACZ16533

SEQ ID NO: 109174 - RNA, 1410 nt, Artificial Sequence; identical to SEQ ID NO: 108240
  derived and/or modified sequence opt2 from neuraminidase__InfluenzaA__ACZ16543

SEQ ID NO: 109175 - RNA, 1410 nt, Artificial Sequence; identical to SEQ ID NO: 108250
  derived and/or modified sequence opt2 from neuraminidase__InfluenzaA__ACZ16553

SEQ ID NO: 109176 - RNA, 1410 nt, Artificial Sequence; identical to SEQ ID NO: 108250
  derived and/or modified sequence opt2 from neuraminidase__InfluenzaA__ACZ16586

SEQ ID NO: 109177 - RNA, 1410 nt, Artificial Sequence; identical to SEQ ID NO: 108250
  derived and/or modified sequence opt2 from neuraminidase__InfluenzaA__ACZ16596

SEQ ID NO: 109178 - RNA, 1410 nt, Artificial Sequence; identical to SEQ ID NO: 108250
  derived and/or modified sequence opt2 from neuraminidase__InfluenzaA__ACZ16606

SEQ ID NO: 109179 - RNA, 1410 nt, Artificial Sequence; identical to SEQ ID NO: 108250
  derived and/or modified sequence opt2 from neuraminidase__InfluenzaA__ACZ16633

SEQ ID NO: 109180 - RNA, 1410 nt, Artificial Sequence
  derived and/or modified sequence opt2 from neuraminidase__InfluenzaA__ACZ16643
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccuccgcuacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109181 - RNA, 1410 nt, Artificial Sequence; identical to SEQ ID NO: 108250
  derived and/or modified sequence opt2 from neuraminidase__InfluenzaA__ACZ16653

SEQ ID NO: 109182 - RNA, 1410 nt, Artificial Sequence; identical to SEQ ID NO: 108250
  derived and/or modified sequence opt2 from neuraminidase__InfluenzaA__ACZ16663

SEQ ID NO: 109183 - RNA, 1410 nt, Artificial Sequence; identical to SEQ ID NO: 108250
  derived and/or modified sequence opt2 from neuraminidase__InfluenzaA__ACZ16673

SEQ ID NO: 109184 - RNA, 1410 nt, Artificial Sequence; identical to SEQ ID NO: 108250
  derived and/or modified sequence opt2 from neuraminidase__InfluenzaA__ACZ16683

SEQ ID NO: 109185 - RNA, 1410 nt, Artificial Sequence; identical to SEQ ID NO: 108250
  derived and/or modified sequence opt2 from neuraminidase__InfluenzaA__ACZ16693

SEQ ID NO: 109186 - RNA, 1410 nt, Artificial Sequence; identical to SEQ ID NO: 108250
  derived and/or modified sequence opt2 from neuraminidase__InfluenzaA__ACZ16703

SEQ ID NO: 109187 - RNA, 1410 nt, Artificial Sequence; identical to SEQ ID NO: 108250
  derived and/or modified sequence opt2 from neuraminidase__InfluenzaA__ACZ16713

SEQ ID NO: 109188 - RNA, 1410 nt, Artificial Sequence; identical to SEQ ID NO: 108250
  derived and/or modified sequence opt2 from neuraminidase__InfluenzaA__ACZ16723

SEQ ID NO: 109189 - RNA, 1410 nt, Artificial Sequence; identical to SEQ ID NO: 108250
  derived and/or modified sequence opt2 from neuraminidase__InfluenzaA__ACZ16733

SEQ ID NO: 109190 - RNA, 1410 nt, Artificial Sequence; identical to SEQ ID NO: 108250
  derived and/or modified sequence opt2 from neuraminidase__InfluenzaA__ACZ16743

SEQ ID NO: 109191 - RNA, 1410 nt, Artificial Sequence; identical to SEQ ID NO: 108250
  derived and/or modified sequence opt2 from neuraminidase__InfluenzaA__ACZ16753

SEQ ID NO: 109192 - RNA, 1410 nt, Artificial Sequence; identical to SEQ ID NO: 108250
  derived and/or modified sequence opt2 from neuraminidase__InfluenzaA__ACZ16763

SEQ ID NO: 109193 - RNA, 1410 nt, Artificial Sequence; identical to SEQ ID NO: 108240
  derived and/or modified sequence opt2 from neuraminidase__InfluenzaA__ACZ16773

SEQ ID NO: 109194 - RNA, 1410 nt, Artificial Sequence; identical to SEQ ID NO: 108250
  derived and/or modified sequence opt2 from neuraminidase__InfluenzaA__ACZ16783

SEQ ID NO: 109195 - RNA, 1410 nt, Artificial Sequence; identical to SEQ ID NO: 108250
  derived and/or modified sequence opt2 from neuraminidase__InfluenzaA__ACZ16793

SEQ ID NO: 109196 - RNA, 1410 nt, Artificial Sequence; identical to SEQ ID NO: 108250
  derived and/or modified sequence opt2 from neuraminidase__InfluenzaA__ACZ16803

SEQ ID NO: 109197 - RNA, 1410 nt, Artificial Sequence; identical to SEQ ID NO: 108250
  derived and/or modified sequence opt2 from neuraminidase__InfluenzaA__ACZ16813

SEQ ID NO: 109198 - RNA, 1410 nt, Artificial Sequence; identical to SEQ ID NO: 108240
  derived and/or modified sequence opt2 from neuraminidase__InfluenzaA__ACZ16823

SEQ ID NO: 109199 - RNA, 1410 nt, Artificial Sequence; identical to SEQ ID NO: 108250
  derived and/or modified sequence opt2 from neuraminidase__InfluenzaA__ACZ16833

SEQ ID NO: 109200 - RNA, 1410 nt, Artificial Sequence; identical to SEQ ID NO: 108250
  derived and/or modified sequence opt2 from neuraminidase__InfluenzaA__ACZ16843

SEQ ID NO: 109201 - RNA, 1410 nt, Artificial Sequence; identical to SEQ ID NO: 109170
  derived and/or modified sequence opt2 from neuraminidase__InfluenzaA__ACZ16853

SEQ ID NO: 109202 - RNA, 1410 nt, Artificial Sequence; identical to SEQ ID NO: 108250
  derived and/or modified sequence opt2 from neuraminidase__InfluenzaA__ACZ16863

SEQ ID NO: 109203 - RNA, 1410 nt, Artificial Sequence; identical to SEQ ID NO: 108250
  derived and/or modified sequence opt2 from neuraminidase__InfluenzaA__ACZ16873

SEQ ID NO: 109204 - RNA, 1410 nt, Artificial Sequence; identical to SEQ ID NO: 108250
  derived and/or modified sequence opt2 from neuraminidase__InfluenzaA__ACZ16883

SEQ ID NO: 109205 - RNA, 1410 nt, Artificial Sequence; identical to SEQ ID NO: 108250
  derived and/or modified sequence opt2 from neuraminidase__InfluenzaA__ACZ16893

SEQ ID NO: 109206 - RNA, 1410 nt, Artificial Sequence; identical to SEQ ID NO: 108250
  derived and/or modified sequence opt2 from neuraminidase__InfluenzaA__ACZ16903

SEQ ID NO: 109207 - RNA, 1410 nt, Artificial Sequence; identical to SEQ ID NO: 108250
  derived and/or modified sequence opt2 from neuraminidase__InfluenzaA__ACZ16913

SEQ ID NO: 109208 - RNA, 1410 nt, Artificial Sequence; identical to SEQ ID NO: 108250
  derived and/or modified sequence opt2 from neuraminidase__InfluenzaA__ACZ16923

SEQ ID NO: 109209 - RNA, 1410 nt, Artificial Sequence; identical to SEQ ID NO: 108250
  derived and/or modified sequence opt2 from neuraminidase__InfluenzaA__ACZ16933

SEQ ID NO: 109210 - RNA, 1410 nt, Artificial Sequence; identical to SEQ ID NO: 108250
  derived and/or modified sequence opt2 from neuraminidase__InfluenzaA__ACZ16943

SEQ ID NO: 109211 - RNA, 1410 nt, Artificial Sequence; identical to SEQ ID NO: 108240
  derived and/or modified sequence opt2 from neuraminidase__InfluenzaA__ACZ16953

SEQ ID NO: 109212 - RNA, 1410 nt, Artificial Sequence; identical to SEQ ID NO: 108250
  derived and/or modified sequence opt2 from neuraminidase__InfluenzaA__ACZ16963

SEQ ID NO: 109213 - RNA, 1410 nt, Artificial Sequence; identical to SEQ ID NO: 108250
  derived and/or modified sequence opt2 from neuraminidase__InfluenzaA__ACZ16973

SEQ ID NO: 109214 - RNA, 1410 nt, Artificial Sequence; identical to SEQ ID NO: 108250
  derived and/or modified sequence opt2 from neuraminidase__InfluenzaA__ACZ16983

SEQ ID NO: 109215 - RNA, 1410 nt, Artificial Sequence; identical to SEQ ID NO: 108250
  derived and/or modified sequence opt2 from neuraminidase__InfluenzaA__ACZ16993

SEQ ID NO: 109216 - RNA, 1410 nt, Artificial Sequence; identical to SEQ ID NO: 108250
  derived and/or modified sequence opt2 from neuraminidase__InfluenzaA__ACZ17003

SEQ ID NO: 109217 - RNA, 1410 nt, Artificial Sequence; identical to SEQ ID NO: 108250
  derived and/or modified sequence opt2 from neuraminidase__InfluenzaA__ACZ17023

SEQ ID NO: 109218 - RNA, 1410 nt, Artificial Sequence; identical to SEQ ID NO: 108250
  derived and/or modified sequence opt2 from neuraminidase__InfluenzaA__ACZ17043

SEQ ID NO: 109219 - RNA, 1410 nt, Artificial Sequence; identical to SEQ ID NO: 108250
  derived and/or modified sequence opt2 from neuraminidase__InfluenzaA__ACZ17053

SEQ ID NO: 109220 - RNA, 1410 nt, Artificial Sequence
  derived and/or modified sequence opt2 from neuraminidase__InfluenzaA__ACZ17063
augaaccccaaccagaagaucaucaccaucggcuccgucugcaugaccaucggcauggccaaccucauccuccagaucggcaacaucaucuccaucuggaucucccacuccauccagcucggcgaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109221 - RNA, 1410 nt, Artificial Sequence; identical to SEQ ID NO: 108250
  derived and/or modified sequence opt2 from neuraminidase__InfluenzaA__ACZ17073

SEQ ID NO: 109222 - RNA, 1410 nt, Artificial Sequence; identical to SEQ ID NO: 108958
  derived and/or modified sequence opt2 from neuraminidase__InfluenzaA__ACZ17083

SEQ ID NO: 109223 - RNA, 1410 nt, Artificial Sequence
  derived and/or modified sequence opt2 from neuraminidase__InfluenzaA__ACZ17093
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109224 - RNA, 1410 nt, Artificial Sequence
  derived and/or modified sequence opt2 from neuraminidase__InfluenzaA__ACZ17113
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109225 - RNA, 1410 nt, Artificial Sequence; identical to SEQ ID NO: 108250
  derived and/or modified sequence opt2 from neuraminidase__InfluenzaA__ACZ17123

SEQ ID NO: 109226 - RNA, 1410 nt, Artificial Sequence; identical to SEQ ID NO: 108250
  derived and/or modified sequence opt2 from neuraminidase__InfluenzaA__ACZ17133

SEQ ID NO: 109227 - RNA, 1410 nt, Artificial Sequence
  derived and/or modified sequence opt2 from neuraminidase__InfluenzaA__ACZ17163
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccgcaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109228 - RNA, 1410 nt, Artificial Sequence; identical to SEQ ID NO: 109227
  derived and/or modified sequence opt2 from neuraminidase__InfluenzaA__ACZ17173

SEQ ID NO: 109229 - RNA, 1410 nt, Artificial Sequence; identical to SEQ ID NO: 109227
  derived and/or modified sequence opt2 from neuraminidase__InfluenzaA__ACZ17183

SEQ ID NO: 109230 - RNA, 1410 nt, Artificial Sequence; identical to SEQ ID NO: 109227
  derived and/or modified sequence opt2 from neuraminidase__InfluenzaA__ACZ17193

SEQ ID NO: 109231 - RNA, 1410 nt, Artificial Sequence; identical to SEQ ID NO: 109227
  derived and/or modified sequence opt2 from neuraminidase__InfluenzaA__ACZ17203

SEQ ID NO: 109232 - RNA, 1410 nt, Artificial Sequence; identical to SEQ ID NO: 108250
  derived and/or modified sequence opt2 from neuraminidase__InfluenzaA__ACZ17213

SEQ ID NO: 109233 - RNA, 1410 nt, Artificial Sequence; identical to SEQ ID NO: 108250
  derived and/or modified sequence opt2 from neuraminidase__InfluenzaA__ACZ17223

SEQ ID NO: 109234 - RNA, 1410 nt, Artificial Sequence; identical to SEQ ID NO: 108250
  derived and/or modified sequence opt2 from neuraminidase__InfluenzaA__ACZ17233

SEQ ID NO: 109235 - RNA, 1410 nt, Artificial Sequence; identical to SEQ ID NO: 108250
  derived and/or modified sequence opt2 from neuraminidase__InfluenzaA__ACZ17243

SEQ ID NO: 109236 - RNA, 1410 nt, Artificial Sequence; identical to SEQ ID NO: 108250
  derived and/or modified sequence opt2 from neuraminidase__InfluenzaA__ACZ17263

SEQ ID NO: 109237 - RNA, 1410 nt, Artificial Sequence
  derived and/or modified sequence opt2 from neuraminidase__InfluenzaA__ACZ17273
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcuucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109238 - RNA, 1410 nt, Artificial Sequence; identical to SEQ ID NO: 108250
  derived and/or modified sequence opt2 from neuraminidase__InfluenzaA__ACZ17283

SEQ ID NO: 109239 - RNA, 1410 nt, Artificial Sequence; identical to SEQ ID NO: 108280
  derived and/or modified sequence opt2 from neuraminidase__InfluenzaA__ACZ17293

SEQ ID NO: 109240 - RNA, 1410 nt, Artificial Sequence; identical to SEQ ID NO: 108280
  derived and/or modified sequence opt2 from neuraminidase__InfluenzaA__ACZ17303

SEQ ID NO: 109241 - RNA, 1410 nt, Artificial Sequence; identical to SEQ ID NO: 108280
  derived and/or modified sequence opt2 from neuraminidase__InfluenzaA__ACZ17313

SEQ ID NO: 109242 - RNA, 1410 nt, Artificial Sequence; identical to SEQ ID NO: 108250
  derived and/or modified sequence opt2 from neuraminidase__InfluenzaA__ACZ17401

SEQ ID NO: 109243 - RNA, 1410 nt, Artificial Sequence; identical to SEQ ID NO: 108250
  derived and/or modified sequence opt2 from neuraminidase__InfluenzaA__ACZ17411

SEQ ID NO: 109244 - RNA, 1410 nt, Artificial Sequence; identical to SEQ ID NO: 108250
  derived and/or modified sequence opt2 from neuraminidase__InfluenzaA__ACZ17421

SEQ ID NO: 109245 - RNA, 1410 nt, Artificial Sequence
  derived and/or modified sequence opt2 from neuraminidase__InfluenzaA__ACZ17431
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109246 - RNA, 1410 nt, Artificial Sequence; identical to SEQ ID NO: 109245
  derived and/or modified sequence opt2 from neuraminidase__InfluenzaA__ACZ17441

SEQ ID NO: 109247 - RNA, 1410 nt, Artificial Sequence; identical to SEQ ID NO: 108240
  derived and/or modified sequence opt2 from neuraminidase__InfluenzaA__ACZ17451

SEQ ID NO: 109248 - RNA, 1410 nt, Artificial Sequence; identical to SEQ ID NO: 108250
  derived and/or modified sequence opt2 from neuraminidase__InfluenzaA__ACZ17461

SEQ ID NO: 109249 - RNA, 1410 nt, Artificial Sequence; identical to SEQ ID NO: 108250
  derived and/or modified sequence opt2 from neuraminidase__InfluenzaA__ACZ17471

SEQ ID NO: 109250 - RNA, 1410 nt, Artificial Sequence; identical to SEQ ID NO: 108280
  derived and/or modified sequence opt2 from neuraminidase__InfluenzaA__ACZ17481

SEQ ID NO: 109251 - RNA, 1410 nt, Artificial Sequence; identical to SEQ ID NO: 108250
  derived and/or modified sequence opt2 from neuraminidase__InfluenzaA__ACZ17491

SEQ ID NO: 109252 - RNA, 1410 nt, Artificial Sequence; identical to SEQ ID NO: 108716
  derived and/or modified sequence opt2 from neuraminidase__InfluenzaA__ACZ27803

SEQ ID NO: 109253 - RNA, 1410 nt, Artificial Sequence; identical to SEQ ID NO: 108240
  derived and/or modified sequence opt2 from neuraminidase__InfluenzaA__ACZ27813

SEQ ID NO: 109254 - RNA, 1410 nt, Artificial Sequence; identical to SEQ ID NO: 108250
  derived and/or modified sequence opt2 from neuraminidase__InfluenzaA__ACZ27823

SEQ ID NO: 109255 - RNA, 1410 nt, Artificial Sequence; identical to SEQ ID NO: 108240
  derived and/or modified sequence opt2 from neuraminidase__InfluenzaA__ACZ27833

SEQ ID NO: 109256 - RNA, 1410 nt, Artificial Sequence; identical to SEQ ID NO: 108250
  derived and/or modified sequence opt2 from neuraminidase__InfluenzaA__ACZ45022

SEQ ID NO: 109257 - RNA, 1410 nt, Artificial Sequence
  derived and/or modified sequence opt2 from neuraminidase__InfluenzaA__ACZ53958
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccugccccgacggcuccguccucaaccucaugcccaucuga

SEQ ID NO: 109258 - RNA, 1410 nt, Artificial Sequence
  derived and/or modified sequence opt2 from neuraminidase__InfluenzaA__ACZ53969
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcgagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcuccguccucaaccucaugcccaucuga

SEQ ID NO: 109259 - RNA, 1410 nt, Artificial Sequence
  derived and/or modified sequence opt2 from neuraminidase__InfluenzaA__ACZ53980
augaaccccaaccagaacaagcuccccaucggcuccgucucccucaccaucgccaccaucugcuuccucaugcagaucgccauccucaagaccaccgucacccuccacuucaagcaguacgagugcaacuccccccccaacaaccaggucaugcucugcgagcccaccaucaucgagcgcaaccucaccaagaucgucuaccucaccaacaccaccaucaagaaggagaucugccccaagcagcccaaguaccgcaacugguccaagcccaagugcaagaucaccgagcucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcuccguccucaaccucaugcccaucuga

SEQ ID NO: 109260 - RNA, 1410 nt, Artificial Sequence; identical to SEQ ID NO: 108250
  derived and/or modified sequence opt2 from neuraminidase__InfluenzaA__ACZ56082

SEQ ID NO: 109261 - RNA, 1410 nt, Artificial Sequence; identical to SEQ ID NO: 108833
  derived and/or modified sequence opt2 from neuraminidase__InfluenzaA__ACZ57183

SEQ ID NO: 109262 - RNA, 1413 nt, Artificial Sequence
  derived and/or modified sequence opt2 from neuraminidase__InfluenzaA__ACZ81542
augaaccccaaccagaaggucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109263 - RNA, 1413 nt, Artificial Sequence
  derived and/or modified sequence opt2 from neuraminidase__InfluenzaA__ACZ81543
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacaacaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaaggagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaccggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109264 - RNA, 1410 nt, Artificial Sequence
  derived and/or modified sequence opt2 from neuraminidase__InfluenzaA__ACZ81546
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuccgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109265 - RNA, 1410 nt, Artificial Sequence
  derived and/or modified sequence opt2 from neuraminidase__InfluenzaA__ACZ81547
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaccaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109266 - RNA, 1410 nt, Artificial Sequence; identical to SEQ ID NO: 108250
  derived and/or modified sequence opt2 from neuraminidase__InfluenzaA__ACZ81634

SEQ ID NO: 109267 - RNA, 1410 nt, Artificial Sequence
  derived and/or modified sequence opt2 from neuraminidase__InfluenzaA__ACZ81644
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109268 - RNA, 1410 nt, Artificial Sequence
  derived and/or modified sequence opt2 from neuraminidase__InfluenzaA__ACZ81653
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109269 - RNA, 1410 nt, Artificial Sequence; identical to SEQ ID NO: 108250
  derived and/or modified sequence opt2 from neuraminidase__InfluenzaA__ACZ95840

SEQ ID NO: 109270 - RNA, 1410 nt, Artificial Sequence; identical to SEQ ID NO: 108250
  derived and/or modified sequence opt2 from neuraminidase__InfluenzaA__ACZ95850

SEQ ID NO: 109271 - RNA, 1410 nt, Artificial Sequence; identical to SEQ ID NO: 108250
  derived and/or modified sequence opt2 from neuraminidase__InfluenzaA__ACZ95860

SEQ ID NO: 109272 - RNA, 1410 nt, Artificial Sequence; identical to SEQ ID NO: 108250
  derived and/or modified sequence opt2 from neuraminidase__InfluenzaA__ACZ95870

SEQ ID NO: 109273 - RNA, 1410 nt, Artificial Sequence; identical to SEQ ID NO: 108250
  derived and/or modified sequence opt2 from neuraminidase__InfluenzaA__ACZ95880

SEQ ID NO: 109274 - RNA, 1410 nt, Artificial Sequence; identical to SEQ ID NO: 108250
  derived and/or modified sequence opt2 from neuraminidase__InfluenzaA__ACZ95890

SEQ ID NO: 109275 - RNA, 1410 nt, Artificial Sequence; identical to SEQ ID NO: 108250
  derived and/or modified sequence opt2 from neuraminidase__InfluenzaA__ACZ95900

SEQ ID NO: 109276 - RNA, 1410 nt, Artificial Sequence; identical to SEQ ID NO: 108250
  derived and/or modified sequence opt2 from neuraminidase__InfluenzaA__ACZ95910

SEQ ID NO: 109277 - RNA, 1410 nt, Artificial Sequence; identical to SEQ ID NO: 108250
  derived and/or modified sequence opt2 from neuraminidase__InfluenzaA__ACZ95920

SEQ ID NO: 109278 - RNA, 1410 nt, Artificial Sequence; identical to SEQ ID NO: 109137
  derived and/or modified sequence opt2 from neuraminidase__InfluenzaA__ACZ95930

SEQ ID NO: 109279 - RNA, 1410 nt, Artificial Sequence; identical to SEQ ID NO: 108250
  derived and/or modified sequence opt2 from neuraminidase__InfluenzaA__ACZ95940

SEQ ID NO: 109280 - RNA, 1410 nt, Artificial Sequence; identical to SEQ ID NO: 109267
  derived and/or modified sequence opt2 from neuraminidase__InfluenzaA__ACZ95950

SEQ ID NO: 109281 - RNA, 1410 nt, Artificial Sequence; identical to SEQ ID NO: 108250
  derived and/or modified sequence opt2 from neuraminidase__InfluenzaA__ACZ95960

SEQ ID NO: 109282 - RNA, 1410 nt, Artificial Sequence; identical to SEQ ID NO: 109267
  derived and/or modified sequence opt2 from neuraminidase__InfluenzaA__ACZ95970

SEQ ID NO: 109283 - RNA, 1410 nt, Artificial Sequence; identical to SEQ ID NO: 108250
  derived and/or modified sequence opt2 from neuraminidase__InfluenzaA__ACZ95980

SEQ ID NO: 109284 - RNA, 1410 nt, Artificial Sequence; identical to SEQ ID NO: 108250
  derived and/or modified sequence opt2 from neuraminidase__InfluenzaA__ACZ95990

SEQ ID NO: 109285 - RNA, 1410 nt, Artificial Sequence; identical to SEQ ID NO: 108250
  derived and/or modified sequence opt2 from neuraminidase__InfluenzaA__ACZ96000

SEQ ID NO: 109286 - RNA, 1410 nt, Artificial Sequence; identical to SEQ ID NO: 108250
  derived and/or modified sequence opt2 from neuraminidase__InfluenzaA__ACZ96010

SEQ ID NO: 109287 - RNA, 1410 nt, Artificial Sequence
  derived and/or modified sequence opt2 from neuraminidase__InfluenzaA__ACZ96020
augaaccccaaccagaagaucaucaccaucggcuccgucugcaugaccaucggcauggccaaccucauccuccagaucggcaacaucauccucaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaucgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109288 - RNA, 1410 nt, Artificial Sequence; identical to SEQ ID NO: 108250
  derived and/or modified sequence opt2 from neuraminidase__InfluenzaA__ACZ96050

SEQ ID NO: 109289 - RNA, 1410 nt, Artificial Sequence; identical to SEQ ID NO: 108250
  derived and/or modified sequence opt2 from neuraminidase__InfluenzaA__ACZ96060

SEQ ID NO: 109290 - RNA, 1410 nt, Artificial Sequence; identical to SEQ ID NO: 108250
  derived and/or modified sequence opt2 from neuraminidase__InfluenzaA__ACZ96072

SEQ ID NO: 109291 - RNA, 1410 nt, Artificial Sequence; identical to SEQ ID NO: 108250
  derived and/or modified sequence opt2 from neuraminidase__InfluenzaA__ACZ96082

SEQ ID NO: 109292 - RNA, 1410 nt, Artificial Sequence; identical to SEQ ID NO: 108250
  derived and/or modified sequence opt2 from neuraminidase__InfluenzaA__ACZ96092

SEQ ID NO: 109293 - RNA, 1410 nt, Artificial Sequence; identical to SEQ ID NO: 108250
  derived and/or modified sequence opt2 from neuraminidase__InfluenzaA__ACZ96102

SEQ ID NO: 109294 - RNA, 1410 nt, Artificial Sequence; identical to SEQ ID NO: 108250
  derived and/or modified sequence opt2 from neuraminidase__InfluenzaA__ACZ96112

SEQ ID NO: 109295 - RNA, 1410 nt, Artificial Sequence
  derived and/or modified sequence opt2 from neuraminidase__InfluenzaA__ACZ96122
augaaccccaaccagaagaucaucaccaucggcuccgucugcaugaccaucggcauggccaaccucauccuccagaucggcaacaucaucuccaucuggaucucccacuccauccagcucggcaaccagaaccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaaggacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcaucaacuccgacaccgucggcugguccuggcccgacggcgccgagcuccccuucaccaucgacaaguga

SEQ ID NO: 109296 - RNA, 1410 nt, Artificial Sequence; identical to SEQ ID NO: 108250
  derived and/or modified sequence opt2 from neuraminidase__InfluenzaA__ACZ96132

SEQ ID NO: 109297 - RNA, 1410 nt, Artificial Sequence; identical to SEQ ID NO: 108250
  derived and/or modified sequence opt2 from neuraminidase__InfluenzaA__ACZ96142

SEQ ID NO: 109298 - RNA, 1410 nt, Artificial Sequence; identical to SEQ ID NO: 108250
  derived and/or modified sequence opt2 from neuraminidase__InfluenzaA__ACZ96152

SEQ ID NO: 109299 - RNA, 1410 nt, Artificial Sequence; identical to SEQ ID NO: 108250
  derived and/or modified sequence opt2 from neuraminidase__InfluenzaA__ACZ96162

SEQ ID NO: 109300 - RNA, 1410 nt, Artificial Sequence; identical to SEQ ID NO: 108250
  derived and/or modified sequence opt2 from neuraminidase__InfluenzaA__ACZ96172

SEQ ID NO: 109301 - RNA, 1410 nt, Artificial Sequence
  derived and/or modified sequence opt2 from neuraminidase__InfluenzaA__ACZ96182
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgaccgccacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109302 - RNA, 1410 nt, Artificial Sequence
  derived and/or modified sequence opt2 from neuraminidase__InfluenzaA__ACZ96192
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcuccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109303 - RNA, 1410 nt, Artificial Sequence
  derived and/or modified sequence opt2 from neuraminidase__InfluenzaA__ACZ96232
augaaccccaaccagaagaucaucaccaucggcuccgucugcaugaccgucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109304 - RNA, 1410 nt, Artificial Sequence
  derived and/or modified sequence opt2 from neuraminidase__InfluenzaA__ACZ96242
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 109305 - RNA, 1410 nt, Artificial Sequence; identical to SEQ ID NO: 108250
  derived and/or modified sequence opt2 from neuraminidase__InfluenzaA__ACZ96252

SEQ ID NO: 109306 - RNA, 1410 nt, Artificial Sequence; identical to SEQ ID NO: 108250
  derived and/or modified sequence opt2 from neuraminidase__InfluenzaA__ACZ96292

SEQ ID NO: 109307 - RNA, 1410 nt, Artificial Sequence; identical to SEQ ID NO: 108250
  derived and/or modified sequence opt2 from neuraminidase__InfluenzaA__ACZ96302

SEQ ID NO: 109308 - RNA, 1410 nt, Artificial Sequence; identical to SEQ ID NO: 108250
  derived and/or modified sequence opt2 from neuraminidase__InfluenzaA__ACZ96312

SEQ ID NO: 109309 - RNA, 1410 nt, Artificial Sequence
  derived and/or modified sequence opt2 from neuraminidase__InfluenzaA__ACZ96322
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucaccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109310 - RNA, 1410 nt, Artificial Sequence; identical to SEQ ID NO: 109309
  derived and/or modified sequence opt2 from neuraminidase__InfluenzaA__ACZ96332

SEQ ID NO: 109311 - RNA, 1410 nt, Artificial Sequence; identical to SEQ ID NO: 108250
  derived and/or modified sequence opt2 from neuraminidase__InfluenzaA__ACZ96352

SEQ ID NO: 109312 - RNA, 1410 nt, Artificial Sequence; identical to SEQ ID NO: 109309
  derived and/or modified sequence opt2 from neuraminidase__InfluenzaA__ACZ96362

SEQ ID NO: 109313 - RNA, 1410 nt, Artificial Sequence; identical to SEQ ID NO: 108250
  derived and/or modified sequence opt2 from neuraminidase__InfluenzaA__ACZ96375

SEQ ID NO: 109314 - RNA, 1410 nt, Artificial Sequence; identical to SEQ ID NO: 109309
  derived and/or modified sequence opt2 from neuraminidase__InfluenzaA__ACZ96385

SEQ ID NO: 109315 - RNA, 1410 nt, Artificial Sequence
  derived and/or modified sequence opt2 from neuraminidase__InfluenzaA__ACZ96395
augaaccccaaccagaagaucaucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaucgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109316 - RNA, 1410 nt, Artificial Sequence; identical to SEQ ID NO: 108250
  derived and/or modified sequence opt2 from neuraminidase__InfluenzaA__ACZ96408

SEQ ID NO: 109317 - RNA, 1410 nt, Artificial Sequence; identical to SEQ ID NO: 108250
  derived and/or modified sequence opt2 from neuraminidase__InfluenzaA__ACZ96428

SEQ ID NO: 109318 - RNA, 1410 nt, Artificial Sequence; identical to SEQ ID NO: 108250
  derived and/or modified sequence opt2 from neuraminidase__InfluenzaA__ACZ96438

SEQ ID NO: 109319 - RNA, 1410 nt, Artificial Sequence; identical to SEQ ID NO: 108250
  derived and/or modified sequence opt2 from neuraminidase__InfluenzaA__ACZ96448

SEQ ID NO: 109320 - RNA, 1410 nt, Artificial Sequence; identical to SEQ ID NO: 108250
  derived and/or modified sequence opt2 from neuraminidase__InfluenzaA__ACZ96479

SEQ ID NO: 109321 - RNA, 1410 nt, Artificial Sequence; identical to SEQ ID NO: 109267
  derived and/or modified sequence opt2 from neuraminidase__InfluenzaA__ACZ96489

SEQ ID NO: 109322 - RNA, 1410 nt, Artificial Sequence; identical to SEQ ID NO: 108250
  derived and/or modified sequence opt2 from neuraminidase__InfluenzaA__ACZ96499

SEQ ID NO: 109323 - RNA, 1410 nt, Artificial Sequence
  derived and/or modified sequence opt2 from neuraminidase__InfluenzaA__ACZ96509
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccuggaucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109324 - RNA, 1410 nt, Artificial Sequence; identical to SEQ ID NO: 108250
  derived and/or modified sequence opt2 from neuraminidase__InfluenzaA__ACZ96519

SEQ ID NO: 109325 - RNA, 1410 nt, Artificial Sequence; identical to SEQ ID NO: 108250
  derived and/or modified sequence opt2 from neuraminidase__InfluenzaA__ACZ96529

SEQ ID NO: 109326 - RNA, 1410 nt, Artificial Sequence
  derived and/or modified sequence opt2 from neuraminidase__InfluenzaA__ACZ96552
augaaccccaaccagaagaucaucaccaucggcuccgucugcaugaccaucggcauggccaaccucauccuccagaucggcaacaucaucuccaucuggaucucccacuccucccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109327 - RNA, 1410 nt, Artificial Sequence; identical to SEQ ID NO: 108250
  derived and/or modified sequence opt2 from neuraminidase__InfluenzaA__ACZ96562

SEQ ID NO: 109328 - RNA, 1410 nt, Artificial Sequence; identical to SEQ ID NO: 108250
  derived and/or modified sequence opt2 from neuraminidase__InfluenzaA__ACZ96572

SEQ ID NO: 109329 - RNA, 1410 nt, Artificial Sequence; identical to SEQ ID NO: 108250
  derived and/or modified sequence opt2 from neuraminidase__InfluenzaA__ACZ96582

SEQ ID NO: 109330 - RNA, 1410 nt, Artificial Sequence
  derived and/or modified sequence opt2 from neuraminidase__InfluenzaA__ACZ96592
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaguccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109331 - RNA, 1410 nt, Artificial Sequence; identical to SEQ ID NO: 108250
  derived and/or modified sequence opt2 from neuraminidase__InfluenzaA__ACZ96602

SEQ ID NO: 109332 - RNA, 1410 nt, Artificial Sequence
  derived and/or modified sequence opt2 from neuraminidase__InfluenzaA__ACZ96612
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucgucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109333 - RNA, 1410 nt, Artificial Sequence; identical to SEQ ID NO: 108280
  derived and/or modified sequence opt2 from neuraminidase__InfluenzaA__ACZ96622

SEQ ID NO: 109334 - RNA, 1410 nt, Artificial Sequence; identical to SEQ ID NO: 108280
  derived and/or modified sequence opt2 from neuraminidase__InfluenzaA__ACZ96632

SEQ ID NO: 109335 - RNA, 1410 nt, Artificial Sequence; identical to SEQ ID NO: 108280
  derived and/or modified sequence opt2 from neuraminidase__InfluenzaA__ACZ96642

SEQ ID NO: 109336 - RNA, 1410 nt, Artificial Sequence; identical to SEQ ID NO: 108280
  derived and/or modified sequence opt2 from neuraminidase__InfluenzaA__ACZ96652

SEQ ID NO: 109337 - RNA, 1410 nt, Artificial Sequence; identical to SEQ ID NO: 108280
  derived and/or modified sequence opt2 from neuraminidase__InfluenzaA__ACZ96662

SEQ ID NO: 109338 - RNA, 1410 nt, Artificial Sequence; identical to SEQ ID NO: 108280
  derived and/or modified sequence opt2 from neuraminidase__InfluenzaA__ACZ96672

SEQ ID NO: 109339 - RNA, 1410 nt, Artificial Sequence; identical to SEQ ID NO: 108280
  derived and/or modified sequence opt2 from neuraminidase__InfluenzaA__ACZ96682

SEQ ID NO: 109340 - RNA, 1410 nt, Artificial Sequence; identical to SEQ ID NO: 108280
  derived and/or modified sequence opt2 from neuraminidase__InfluenzaA__ACZ96692

SEQ ID NO: 109341 - RNA, 1410 nt, Artificial Sequence; identical to SEQ ID NO: 108280
  derived and/or modified sequence opt2 from neuraminidase__InfluenzaA__ACZ96702

SEQ ID NO: 109342 - RNA, 1410 nt, Artificial Sequence; identical to SEQ ID NO: 108280
  derived and/or modified sequence opt2 from neuraminidase__InfluenzaA__ACZ96712

SEQ ID NO: 109343 - RNA, 1410 nt, Artificial Sequence; identical to SEQ ID NO: 108280
  derived and/or modified sequence opt2 from neuraminidase__InfluenzaA__ACZ96722

SEQ ID NO: 109344 - RNA, 1410 nt, Artificial Sequence; identical to SEQ ID NO: 108280
  derived and/or modified sequence opt2 from neuraminidase__InfluenzaA__ACZ96732

SEQ ID NO: 109345 - RNA, 1410 nt, Artificial Sequence; identical to SEQ ID NO: 108280
  derived and/or modified sequence opt2 from neuraminidase__InfluenzaA__ACZ96742

SEQ ID NO: 109346 - RNA, 1410 nt, Artificial Sequence; identical to SEQ ID NO: 108240
  derived and/or modified sequence opt2 from neuraminidase__InfluenzaA__ACZ96752

SEQ ID NO: 109347 - RNA, 1410 nt, Artificial Sequence; identical to SEQ ID NO: 108240
  derived and/or modified sequence opt2 from neuraminidase__InfluenzaA__ACZ96762

SEQ ID NO: 109348 - RNA, 1410 nt, Artificial Sequence; identical to SEQ ID NO: 108240
  derived and/or modified sequence opt2 from neuraminidase__InfluenzaA__ACZ96772

SEQ ID NO: 109349 - RNA, 1410 nt, Artificial Sequence; identical to SEQ ID NO: 108240
  derived and/or modified sequence opt2 from neuraminidase__InfluenzaA__ACZ96782

SEQ ID NO: 109350 - RNA, 1410 nt, Artificial Sequence; identical to SEQ ID NO: 108240
  derived and/or modified sequence opt2 from neuraminidase__InfluenzaA__ACZ96792

SEQ ID NO: 109351 - RNA, 1410 nt, Artificial Sequence; identical to SEQ ID NO: 108250
  derived and/or modified sequence opt2 from neuraminidase__InfluenzaA__ACZ96802

SEQ ID NO: 109352 - RNA, 1410 nt, Artificial Sequence; identical to SEQ ID NO: 108250
  derived and/or modified sequence opt2 from neuraminidase__InfluenzaA__ACZ96812

SEQ ID NO: 109353 - RNA, 1410 nt, Artificial Sequence; identical to SEQ ID NO: 108833
  derived and/or modified sequence opt2 from neuraminidase__InfluenzaA__ACZ96822

SEQ ID NO: 109354 - RNA, 1410 nt, Artificial Sequence
  derived and/or modified sequence opt2 from neuraminidase__InfluenzaA__ACZ96842
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaucgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109355 - RNA, 1410 nt, Artificial Sequence; identical to SEQ ID NO: 108250
  derived and/or modified sequence opt2 from neuraminidase__InfluenzaA__ACZ96852

SEQ ID NO: 109356 - RNA, 1410 nt, Artificial Sequence; identical to SEQ ID NO: 108250
  derived and/or modified sequence opt2 from neuraminidase__InfluenzaA__ACZ96862

SEQ ID NO: 109357 - RNA, 1410 nt, Artificial Sequence
  derived and/or modified sequence opt2 from neuraminidase__InfluenzaA__ACZ96872
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109358 - RNA, 1410 nt, Artificial Sequence; identical to SEQ ID NO: 108240
  derived and/or modified sequence opt2 from neuraminidase__InfluenzaA__ACZ96882

SEQ ID NO: 109359 - RNA, 1410 nt, Artificial Sequence; identical to SEQ ID NO: 109357
  derived and/or modified sequence opt2 from neuraminidase__InfluenzaA__ACZ96892

SEQ ID NO: 109360 - RNA, 1410 nt, Artificial Sequence; identical to SEQ ID NO: 109357
  derived and/or modified sequence opt2 from neuraminidase__InfluenzaA__ACZ96902

SEQ ID NO: 109361 - RNA, 1410 nt, Artificial Sequence; identical to SEQ ID NO: 108240
  derived and/or modified sequence opt2 from neuraminidase__InfluenzaA__ACZ96912

SEQ ID NO: 109362 - RNA, 1410 nt, Artificial Sequence; identical to SEQ ID NO: 108240
  derived and/or modified sequence opt2 from neuraminidase__InfluenzaA__ACZ96922

SEQ ID NO: 109363 - RNA, 1410 nt, Artificial Sequence; identical to SEQ ID NO: 109357
  derived and/or modified sequence opt2 from neuraminidase__InfluenzaA__ACZ96932

SEQ ID NO: 109364 - RNA, 1410 nt, Artificial Sequence; identical to SEQ ID NO: 109357
  derived and/or modified sequence opt2 from neuraminidase__InfluenzaA__ACZ96942

SEQ ID NO: 109365 - RNA, 1410 nt, Artificial Sequence; identical to SEQ ID NO: 108240
  derived and/or modified sequence opt2 from neuraminidase__InfluenzaA__ACZ96952

SEQ ID NO: 109366 - RNA, 1410 nt, Artificial Sequence; identical to SEQ ID NO: 108240
  derived and/or modified sequence opt2 from neuraminidase__InfluenzaA__ACZ97024

SEQ ID NO: 109367 - RNA, 1410 nt, Artificial Sequence; identical to SEQ ID NO: 109357
  derived and/or modified sequence opt2 from neuraminidase__InfluenzaA__ACZ97336

SEQ ID NO: 109368 - RNA, 1410 nt, Artificial Sequence; identical to SEQ ID NO: 109357
  derived and/or modified sequence opt2 from neuraminidase__InfluenzaA__ACZ97346

SEQ ID NO: 109369 - RNA, 1410 nt, Artificial Sequence; identical to SEQ ID NO: 108250
  derived and/or modified sequence opt2 from neuraminidase__InfluenzaA__ACZ97366

SEQ ID NO: 109370 - RNA, 1410 nt, Artificial Sequence; identical to SEQ ID NO: 108250
  derived and/or modified sequence opt2 from neuraminidase__InfluenzaA__ACZ97376

SEQ ID NO: 109371 - RNA, 1410 nt, Artificial Sequence; identical to SEQ ID NO: 108250
  derived and/or modified sequence opt2 from neuraminidase__InfluenzaA__ACZ97386

SEQ ID NO: 109372 - RNA, 1410 nt, Artificial Sequence; identical to SEQ ID NO: 109357
  derived and/or modified sequence opt2 from neuraminidase__InfluenzaA__ACZ97396

SEQ ID NO: 109373 - RNA, 1410 nt, Artificial Sequence; identical to SEQ ID NO: 108250
  derived and/or modified sequence opt2 from neuraminidase__InfluenzaA__ACZ98171

SEQ ID NO: 109374 - RNA, 1410 nt, Artificial Sequence; identical to SEQ ID NO: 108250
  derived and/or modified sequence opt2 from neuraminidase__InfluenzaA__ACZ98181

SEQ ID NO: 109375 - RNA, 1410 nt, Artificial Sequence
  derived and/or modified sequence opt2 from neuraminidase__InfluenzaA__ACZ98191
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucuccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109376 - RNA, 1410 nt, Artificial Sequence; identical to SEQ ID NO: 108240
  derived and/or modified sequence opt2 from neuraminidase__InfluenzaA__ACZ98201

SEQ ID NO: 109377 - RNA, 1410 nt, Artificial Sequence; identical to SEQ ID NO: 108250
  derived and/or modified sequence opt2 from neuraminidase__InfluenzaA__ACZ98211

SEQ ID NO: 109378 - RNA, 1410 nt, Artificial Sequence; identical to SEQ ID NO: 108250
  derived and/or modified sequence opt2 from neuraminidase__InfluenzaA__ACZ98221

SEQ ID NO: 109379 - RNA, 1410 nt, Artificial Sequence; identical to SEQ ID NO: 108250
  derived and/or modified sequence opt2 from neuraminidase__InfluenzaA__ACZ98231

SEQ ID NO: 109380 - RNA, 1410 nt, Artificial Sequence; identical to SEQ ID NO: 108250
  derived and/or modified sequence opt2 from neuraminidase__InfluenzaA__ACZ98241

SEQ ID NO: 109381 - RNA, 1410 nt, Artificial Sequence; identical to SEQ ID NO: 109227
  derived and/or modified sequence opt2 from neuraminidase__InfluenzaA__ACZ98251

SEQ ID NO: 109382 - RNA, 1410 nt, Artificial Sequence; identical to SEQ ID NO: 108250
  derived and/or modified sequence opt2 from neuraminidase__InfluenzaA__ACZ98261

SEQ ID NO: 109383 - RNA, 1410 nt, Artificial Sequence; identical to SEQ ID NO: 108250
  derived and/or modified sequence opt2 from neuraminidase__InfluenzaA__ACZ98271

SEQ ID NO: 109384 - RNA, 1410 nt, Artificial Sequence; identical to SEQ ID NO: 108250
  derived and/or modified sequence opt2 from neuraminidase__InfluenzaA__ACZ98281

SEQ ID NO: 109385 - RNA, 1410 nt, Artificial Sequence; identical to SEQ ID NO: 108250
  derived and/or modified sequence opt2 from neuraminidase__InfluenzaA__ACZ98291

SEQ ID NO: 109386 - RNA, 1410 nt, Artificial Sequence; identical to SEQ ID NO: 108240
  derived and/or modified sequence opt2 from neuraminidase__InfluenzaA__ACZ98301

SEQ ID NO: 109387 - RNA, 1410 nt, Artificial Sequence
  derived and/or modified sequence opt2 from neuraminidase__InfluenzaA__ACZ98321
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109388 - RNA, 1410 nt, Artificial Sequence; identical to SEQ ID NO: 108250
  derived and/or modified sequence opt2 from neuraminidase__InfluenzaA__ACZ98331

SEQ ID NO: 109389 - RNA, 1410 nt, Artificial Sequence
  derived and/or modified sequence opt2 from neuraminidase__InfluenzaA__ACZ98341
augaaccccaaccagaagaucaucaccaucggcuccgucugcaucaccaucggcauggccaaccucauccuccagaucggcaacaucaucuccaucuggaucucccaccccauccagcucggcaaccagaaccagaucgagaccugcaaccaguccgucaucaccuacgagaacaacaccugggucaaccagaccuacgucaacaucuccaacaccaaccucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109390 - RNA, 1410 nt, Artificial Sequence; identical to SEQ ID NO: 108250
  derived and/or modified sequence opt2 from neuraminidase__InfluenzaA__ACZ98351

SEQ ID NO: 109391 - RNA, 1410 nt, Artificial Sequence; identical to SEQ ID NO: 108250
  derived and/or modified sequence opt2 from neuraminidase__InfluenzaA__ACZ98361

SEQ ID NO: 109392 - RNA, 1410 nt, Artificial Sequence; identical to SEQ ID NO: 108250
  derived and/or modified sequence opt2 from neuraminidase__InfluenzaA__ACZ98371

SEQ ID NO: 109393 - RNA, 1410 nt, Artificial Sequence; identical to SEQ ID NO: 108250
  derived and/or modified sequence opt2 from neuraminidase__InfluenzaA__ACZ98381

SEQ ID NO: 109394 - RNA, 1410 nt, Artificial Sequence; identical to SEQ ID NO: 108250
  derived and/or modified sequence opt2 from neuraminidase__InfluenzaA__ACZ98391

SEQ ID NO: 109395 - RNA, 1410 nt, Artificial Sequence; identical to SEQ ID NO: 108250
  derived and/or modified sequence opt2 from neuraminidase__InfluenzaA__ACZ98401

SEQ ID NO: 109396 - RNA, 1410 nt, Artificial Sequence; identical to SEQ ID NO: 108250
  derived and/or modified sequence opt2 from neuraminidase__InfluenzaA__ACZ98411

SEQ ID NO: 109397 - RNA, 1410 nt, Artificial Sequence; identical to SEQ ID NO: 108280
  derived and/or modified sequence opt2 from neuraminidase__InfluenzaA__ACZ98421

SEQ ID NO: 109398 - RNA, 1410 nt, Artificial Sequence; identical to SEQ ID NO: 108250
  derived and/or modified sequence opt2 from neuraminidase__InfluenzaA__ACZ98431

SEQ ID NO: 109399 - RNA, 1410 nt, Artificial Sequence; identical to SEQ ID NO: 108250
  derived and/or modified sequence opt2 from neuraminidase__InfluenzaA__ACZ98441

SEQ ID NO: 109400 - RNA, 1410 nt, Artificial Sequence; identical to SEQ ID NO: 108250
  derived and/or modified sequence opt2 from neuraminidase__InfluenzaA__ACZ98451

SEQ ID NO: 109401 - RNA, 1410 nt, Artificial Sequence; identical to SEQ ID NO: 108250
  derived and/or modified sequence opt2 from neuraminidase__InfluenzaA__ACZ98461

SEQ ID NO: 109402 - RNA, 1410 nt, Artificial Sequence; identical to SEQ ID NO: 108833
  derived and/or modified sequence opt2 from neuraminidase__InfluenzaA__ACZ98674

SEQ ID NO: 109403 - RNA, 1410 nt, Artificial Sequence; identical to SEQ ID NO: 109357
  derived and/or modified sequence opt2 from neuraminidase__InfluenzaA__ACZ98684

SEQ ID NO: 109404 - RNA, 1410 nt, Artificial Sequence; identical to SEQ ID NO: 109303
  derived and/or modified sequence opt2 from neuraminidase__InfluenzaA__ACZ98694

SEQ ID NO: 109405 - RNA, 1410 nt, Artificial Sequence; identical to SEQ ID NO: 108250
  derived and/or modified sequence opt2 from neuraminidase__InfluenzaA__ADA60801

SEQ ID NO: 109406 - RNA, 1410 nt, Artificial Sequence; identical to SEQ ID NO: 108250
  derived and/or modified sequence opt2 from neuraminidase__InfluenzaA__ADA69294

SEQ ID NO: 109407 - RNA, 1410 nt, Artificial Sequence; identical to SEQ ID NO: 108250
  derived and/or modified sequence opt2 from neuraminidase__InfluenzaA__ADA69304

SEQ ID NO: 109408 - RNA, 1410 nt, Artificial Sequence; identical to SEQ ID NO: 108250
  derived and/or modified sequence opt2 from neuraminidase__InfluenzaA__ADA69314

SEQ ID NO: 109409 - RNA, 1410 nt, Artificial Sequence; identical to SEQ ID NO: 108250
  derived and/or modified sequence opt2 from neuraminidase__InfluenzaA__ADA69324

SEQ ID NO: 109410 - RNA, 1410 nt, Artificial Sequence; identical to SEQ ID NO: 108250
  derived and/or modified sequence opt2 from neuraminidase__InfluenzaA__ADA69334

SEQ ID NO: 109411 - RNA, 1410 nt, Artificial Sequence; identical to SEQ ID NO: 108250
  derived and/or modified sequence opt2 from neuraminidase__InfluenzaA__ADA69451

SEQ ID NO: 109412 - RNA, 1410 nt, Artificial Sequence; identical to SEQ ID NO: 108250
  derived and/or modified sequence opt2 from neuraminidase__InfluenzaA__ADA69453

SEQ ID NO: 109413 - RNA, 1410 nt, Artificial Sequence
  derived and/or modified sequence opt2 from neuraminidase__InfluenzaA__ADA71153
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucucccgcuacgucugcuccggccucgucggcgaccccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 109414 - RNA, 1413 nt, Artificial Sequence
  derived and/or modified sequence opt2 from neuraminidase__InfluenzaA__ADA71155
augaaccccaaccagaagaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaaggucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109415 - RNA, 1413 nt, Artificial Sequence; identical to SEQ ID NO: 108973
  derived and/or modified sequence opt2 from neuraminidase__InfluenzaA__ADA71157

SEQ ID NO: 109416 - RNA, 1413 nt, Artificial Sequence
  derived and/or modified sequence opt2 from neuraminidase__InfluenzaA__ADA71159
augaaccccaaccagaagaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaaggucgucgccggcgagggcaagaccuccgucacccucgccggcaacuccucccucugcuccaucuccggcugggccaucaacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaaccgcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109417 - RNA, 1410 nt, Artificial Sequence
  derived and/or modified sequence opt2 from neuraminidase__InfluenzaA__ADA71161
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 109418 - RNA, 1413 nt, Artificial Sequence
  derived and/or modified sequence opt2 from neuraminidase__InfluenzaA__ADA71165
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuccaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109419 - RNA, 1410 nt, Artificial Sequence
  derived and/or modified sequence opt2 from neuraminidase__InfluenzaA__ADA71167
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 109420 - RNA, 1413 nt, Artificial Sequence
  derived and/or modified sequence opt2 from neuraminidase__InfluenzaA__ADA71169
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaucaacggcuccugcuucaccaucaugaccgacggccccuccgacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 109421 - RNA, 1413 nt, Artificial Sequence; identical to SEQ ID NO: 108973
  derived and/or modified sequence opt2 from neuraminidase__InfluenzaA__ADA71171

SEQ ID NO: 109422 - RNA, 1410 nt, Artificial Sequence
  derived and/or modified sequence opt2 from neuraminidase__InfluenzaA__ADA71173
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgcccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 109423 - RNA, 1413 nt, Artificial Sequence
  derived and/or modified sequence opt2 from neuraminidase__InfluenzaA__ADA71175
augaaccccaaccagaagaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaaggucgucgccggcgaggacaagaccuccgucacccucgccggcaacuccucccucugcuccaucuccggcugggccaucaacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109424 - RNA, 1413 nt, Artificial Sequence; identical to SEQ ID NO: 108973
  derived and/or modified sequence opt2 from neuraminidase__InfluenzaA__ADA71177

SEQ ID NO: 109425 - RNA, 1410 nt, Artificial Sequence
  derived and/or modified sequence opt2 from neuraminidase__InfluenzaA__ADA71193
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaaggucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109426 - RNA, 1410 nt, Artificial Sequence
  derived and/or modified sequence opt2 from neuraminidase__InfluenzaA__ADA79589
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcuccuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaagucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109427 - RNA, 1410 nt, Artificial Sequence
  derived and/or modified sequence opt2 from neuraminidase__InfluenzaA__ADA79599
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109428 - RNA, 1410 nt, Artificial Sequence; identical to SEQ ID NO: 109427
  derived and/or modified sequence opt2 from neuraminidase__InfluenzaA__ADA79609

SEQ ID NO: 109429 - RNA, 1410 nt, Artificial Sequence
  derived and/or modified sequence opt2 from neuraminidase__InfluenzaA__ADA79619
augaaccccaaccagaagaucaucaccaucggcuccaucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109430 - RNA, 1410 nt, Artificial Sequence; identical to SEQ ID NO: 108250
  derived and/or modified sequence opt2 from neuraminidase__InfluenzaA__ADA81211

SEQ ID NO: 109431 - RNA, 1410 nt, Artificial Sequence
  derived and/or modified sequence opt2 from neuraminidase__InfluenzaA__ADA83035
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugcuccaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109432 - RNA, 1410 nt, Artificial Sequence
  derived and/or modified sequence opt2 from neuraminidase__InfluenzaA__ADA83037
augaaccccaaccagaagaucaucaccaucggcuccgucugcaugaccaucggcauggccaaccucauccuccagaucggcaacaucaucuccaucuggaucucccacuccauccagcucggcaaccaggaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109433 - RNA, 1410 nt, Artificial Sequence; identical to SEQ ID NO: 108250
  derived and/or modified sequence opt2 from neuraminidase__InfluenzaA__ADA83588

SEQ ID NO: 109434 - RNA, 1410 nt, Artificial Sequence; identical to SEQ ID NO: 108250
  derived and/or modified sequence opt2 from neuraminidase__InfluenzaA__ADA83592

SEQ ID NO: 109435 - RNA, 1410 nt, Artificial Sequence; identical to SEQ ID NO: 108250
  derived and/or modified sequence opt2 from neuraminidase__InfluenzaA__ADA83596

SEQ ID NO: 109436 - RNA, 1410 nt, Artificial Sequence; identical to SEQ ID NO: 108250
  derived and/or modified sequence opt2 from neuraminidase__InfluenzaA__ADA83600

SEQ ID NO: 109437 - RNA, 1410 nt, Artificial Sequence; identical to SEQ ID NO: 108250
  derived and/or modified sequence opt2 from neuraminidase__InfluenzaA__ADA83604

SEQ ID NO: 109438 - RNA, 1410 nt, Artificial Sequence; identical to SEQ ID NO: 108250
  derived and/or modified sequence opt2 from neuraminidase__InfluenzaA__ADA83608

SEQ ID NO: 109439 - RNA, 1410 nt, Artificial Sequence; identical to SEQ ID NO: 108250
  derived and/or modified sequence opt2 from neuraminidase__InfluenzaA__ADA83612

SEQ ID NO: 109440 - RNA, 1410 nt, Artificial Sequence; identical to SEQ ID NO: 108604
  derived and/or modified sequence opt2 from neuraminidase__InfluenzaA__ADA83616

SEQ ID NO: 109441 - RNA, 1410 nt, Artificial Sequence; identical to SEQ ID NO: 108250
  derived and/or modified sequence opt2 from neuraminidase__InfluenzaA__ADA83624

SEQ ID NO: 109442 - RNA, 1410 nt, Artificial Sequence; identical to SEQ ID NO: 108250
  derived and/or modified sequence opt2 from neuraminidase__InfluenzaA__ADA83630

SEQ ID NO: 109443 - RNA, 1410 nt, Artificial Sequence; identical to SEQ ID NO: 108250
  derived and/or modified sequence opt2 from neuraminidase__InfluenzaA__ADA83634

SEQ ID NO: 109444 - RNA, 1410 nt, Artificial Sequence; identical to SEQ ID NO: 108250
  derived and/or modified sequence opt2 from neuraminidase__InfluenzaA__ADA83638

SEQ ID NO: 109445 - RNA, 1410 nt, Artificial Sequence; identical to SEQ ID NO: 108250
  derived and/or modified sequence opt2 from neuraminidase__InfluenzaA__ADA83642

SEQ ID NO: 109446 - RNA, 1410 nt, Artificial Sequence; identical to SEQ ID NO: 108250
  derived and/or modified sequence opt2 from neuraminidase__InfluenzaA__ADA83649

SEQ ID NO: 109447 - RNA, 1410 nt, Artificial Sequence; identical to SEQ ID NO: 108250
  derived and/or modified sequence opt2 from neuraminidase__InfluenzaA__ADA83653

SEQ ID NO: 109448 - RNA, 1410 nt, Artificial Sequence; identical to SEQ ID NO: 108250
  derived and/or modified sequence opt2 from neuraminidase__InfluenzaA__ADA83657

SEQ ID NO: 109449 - RNA, 1410 nt, Artificial Sequence; identical to SEQ ID NO: 108250
  derived and/or modified sequence opt2 from neuraminidase__InfluenzaA__ADA83661

SEQ ID NO: 109450 - RNA, 1410 nt, Artificial Sequence; identical to SEQ ID NO: 108250
  derived and/or modified sequence opt2 from neuraminidase__InfluenzaA__ADA83669

SEQ ID NO: 109451 - RNA, 1410 nt, Artificial Sequence; identical to SEQ ID NO: 108250
  derived and/or modified sequence opt2 from neuraminidase__InfluenzaA__ADA83673

SEQ ID NO: 109452 - RNA, 1410 nt, Artificial Sequence; identical to SEQ ID NO: 108250
  derived and/or modified sequence opt2 from neuraminidase__InfluenzaA__ADA83677

SEQ ID NO: 109453 - RNA, 1410 nt, Artificial Sequence; identical to SEQ ID NO: 108250
  derived and/or modified sequence opt2 from neuraminidase__InfluenzaA__ADA83681

SEQ ID NO: 109454 - RNA, 1410 nt, Artificial Sequence; identical to SEQ ID NO: 108250
  derived and/or modified sequence opt2 from neuraminidase__InfluenzaA__ADA83685

SEQ ID NO: 109455 - RNA, 1410 nt, Artificial Sequence; identical to SEQ ID NO: 108250
  derived and/or modified sequence opt2 from neuraminidase__InfluenzaA__ADA86069

SEQ ID NO: 109456 - RNA, 1410 nt, Artificial Sequence; identical to SEQ ID NO: 108250
  derived and/or modified sequence opt2 from neuraminidase__InfluenzaA__ADB27973

SEQ ID NO: 109457 - RNA, 1410 nt, Artificial Sequence; identical to SEQ ID NO: 108250
  derived and/or modified sequence opt2 from neuraminidase__InfluenzaA__ADB27983

SEQ ID NO: 109458 - RNA, 1410 nt, Artificial Sequence
  derived and/or modified sequence opt2 from neuraminidase__InfluenzaA__ADB66693
augaaccccaaccagaagaucaucaccaucggcuccgucugcaugaccaucggcauggccaaccucauccuccagaucggcaacaucaucuccaucuggaucauccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109459 - RNA, 1410 nt, Artificial Sequence; identical to SEQ ID NO: 108250
  derived and/or modified sequence opt2 from neuraminidase__InfluenzaA__ADB66695

SEQ ID NO: 109460 - RNA, 1410 nt, Artificial Sequence; identical to SEQ ID NO: 108250
  derived and/or modified sequence opt2 from neuraminidase__InfluenzaA__ADB66696

SEQ ID NO: 109461 - RNA, 1410 nt, Artificial Sequence
  derived and/or modified sequence opt2 from neuraminidase__InfluenzaA__ADB66697
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacgagcaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcauccacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109462 - RNA, 1410 nt, Artificial Sequence; identical to SEQ ID NO: 109425
  derived and/or modified sequence opt2 from neuraminidase__InfluenzaA__ADB81401

SEQ ID NO: 109463 - RNA, 1410 nt, Artificial Sequence; identical to SEQ ID NO: 109268
  derived and/or modified sequence opt2 from neuraminidase__InfluenzaA__ADB81421

SEQ ID NO: 109464 - RNA, 1410 nt, Artificial Sequence; identical to SEQ ID NO: 108604
  derived and/or modified sequence opt2 from neuraminidase__InfluenzaA__ADB81431

SEQ ID NO: 109465 - RNA, 1410 nt, Artificial Sequence; identical to SEQ ID NO: 108250
  derived and/or modified sequence opt2 from neuraminidase__InfluenzaA__ADB81441

SEQ ID NO: 109466 - RNA, 1410 nt, Artificial Sequence
  derived and/or modified sequence opt2 from neuraminidase__InfluenzaA__ADB81451
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109467 - RNA, 1410 nt, Artificial Sequence; identical to SEQ ID NO: 109427
  derived and/or modified sequence opt2 from neuraminidase__InfluenzaA__ADB81461

SEQ ID NO: 109468 - RNA, 1410 nt, Artificial Sequence; identical to SEQ ID NO: 109427
  derived and/or modified sequence opt2 from neuraminidase__InfluenzaA__ADB82942

SEQ ID NO: 109469 - RNA, 1410 nt, Artificial Sequence; identical to SEQ ID NO: 108405
  derived and/or modified sequence opt2 from neuraminidase__InfluenzaA__ADB82945

SEQ ID NO: 109470 - RNA, 1410 nt, Artificial Sequence; identical to SEQ ID NO: 108250
  derived and/or modified sequence opt2 from neuraminidase__InfluenzaA__ADB89132

SEQ ID NO: 109471 - RNA, 1410 nt, Artificial Sequence; identical to SEQ ID NO: 108833
  derived and/or modified sequence opt2 from neuraminidase__InfluenzaA__ADB89142

SEQ ID NO: 109472 - RNA, 1410 nt, Artificial Sequence; identical to SEQ ID NO: 108250
  derived and/or modified sequence opt2 from neuraminidase__InfluenzaA__ADB89224

SEQ ID NO: 109473 - RNA, 1410 nt, Artificial Sequence
  derived and/or modified sequence opt2 from neuraminidase__InfluenzaA__ADB89234
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109474 - RNA, 1410 nt, Artificial Sequence; identical to SEQ ID NO: 108240
  derived and/or modified sequence opt2 from neuraminidase__InfluenzaA__ADB89244

SEQ ID NO: 109475 - RNA, 1410 nt, Artificial Sequence; identical to SEQ ID NO: 108250
  derived and/or modified sequence opt2 from neuraminidase__InfluenzaA__ADB89264

SEQ ID NO: 109476 - RNA, 1410 nt, Artificial Sequence; identical to SEQ ID NO: 109220
  derived and/or modified sequence opt2 from neuraminidase__InfluenzaA__ADB89274

SEQ ID NO: 109477 - RNA, 1410 nt, Artificial Sequence; identical to SEQ ID NO: 108405
  derived and/or modified sequence opt2 from neuraminidase__InfluenzaA__ADB89284

SEQ ID NO: 109478 - RNA, 1410 nt, Artificial Sequence; identical to SEQ ID NO: 108250
  derived and/or modified sequence opt2 from neuraminidase__InfluenzaA__ADB89294

SEQ ID NO: 109479 - RNA, 1410 nt, Artificial Sequence; identical to SEQ ID NO: 108250
  derived and/or modified sequence opt2 from neuraminidase__InfluenzaA__ADB89304

SEQ ID NO: 109480 - RNA, 1410 nt, Artificial Sequence; identical to SEQ ID NO: 108250
  derived and/or modified sequence opt2 from neuraminidase__InfluenzaA__ADB89314

SEQ ID NO: 109481 - RNA, 1410 nt, Artificial Sequence; identical to SEQ ID NO: 108250
  derived and/or modified sequence opt2 from neuraminidase__InfluenzaA__ADB89324

SEQ ID NO: 109482 - RNA, 1410 nt, Artificial Sequence; identical to SEQ ID NO: 108250
  derived and/or modified sequence opt2 from neuraminidase__InfluenzaA__ADB89334

SEQ ID NO: 109483 - RNA, 1410 nt, Artificial Sequence; identical to SEQ ID NO: 108250
  derived and/or modified sequence opt2 from neuraminidase__InfluenzaA__ADB89344

SEQ ID NO: 109484 - RNA, 1410 nt, Artificial Sequence; identical to SEQ ID NO: 108250
  derived and/or modified sequence opt2 from neuraminidase__InfluenzaA__ADB89364

SEQ ID NO: 109485 - RNA, 1410 nt, Artificial Sequence; identical to SEQ ID NO: 108250
  derived and/or modified sequence opt2 from neuraminidase__InfluenzaA__ADB89374

SEQ ID NO: 109486 - RNA, 1410 nt, Artificial Sequence; identical to SEQ ID NO: 108250
  derived and/or modified sequence opt2 from neuraminidase__InfluenzaA__ADB89384

SEQ ID NO: 109487 - RNA, 1410 nt, Artificial Sequence; identical to SEQ ID NO: 108250
  derived and/or modified sequence opt2 from neuraminidase__InfluenzaA__ADB89394

SEQ ID NO: 109488 - RNA, 1410 nt, Artificial Sequence
  derived and/or modified sequence opt2 from neuraminidase__InfluenzaA__ADB89404
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacuccauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109489 - RNA, 1410 nt, Artificial Sequence; identical to SEQ ID NO: 108250
  derived and/or modified sequence opt2 from neuraminidase__InfluenzaA__ADB89414

SEQ ID NO: 109490 - RNA, 1410 nt, Artificial Sequence; identical to SEQ ID NO: 108250
  derived and/or modified sequence opt2 from neuraminidase__InfluenzaA__ADB89424

SEQ ID NO: 109491 - RNA, 1410 nt, Artificial Sequence; identical to SEQ ID NO: 108250
  derived and/or modified sequence opt2 from neuraminidase__InfluenzaA__ADB89434

SEQ ID NO: 109492 - RNA, 1410 nt, Artificial Sequence; identical to SEQ ID NO: 108250
  derived and/or modified sequence opt2 from neuraminidase__InfluenzaA__ADB89444

SEQ ID NO: 109493 - RNA, 1410 nt, Artificial Sequence
  derived and/or modified sequence opt2 from neuraminidase__InfluenzaA__ADB89454
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109494 - RNA, 1410 nt, Artificial Sequence; identical to SEQ ID NO: 108250
  derived and/or modified sequence opt2 from neuraminidase__InfluenzaA__ADB89464

SEQ ID NO: 109495 - RNA, 1410 nt, Artificial Sequence; identical to SEQ ID NO: 108250
  derived and/or modified sequence opt2 from neuraminidase__InfluenzaA__ADB89484

SEQ ID NO: 109496 - RNA, 1410 nt, Artificial Sequence; identical to SEQ ID NO: 108250
  derived and/or modified sequence opt2 from neuraminidase__InfluenzaA__ADB89494

SEQ ID NO: 109497 - RNA, 1410 nt, Artificial Sequence; identical to SEQ ID NO: 108240
  derived and/or modified sequence opt2 from neuraminidase__InfluenzaA__ADB89504

SEQ ID NO: 109498 - RNA, 1410 nt, Artificial Sequence; identical to SEQ ID NO: 108250
  derived and/or modified sequence opt2 from neuraminidase__InfluenzaA__ADB89514

SEQ ID NO: 109499 - RNA, 1410 nt, Artificial Sequence; identical to SEQ ID NO: 108250
  derived and/or modified sequence opt2 from neuraminidase__InfluenzaA__ADB89524

SEQ ID NO: 109500 - RNA, 1410 nt, Artificial Sequence
  derived and/or modified sequence opt2 from neuraminidase__InfluenzaA__ADB89544
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccuccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109501 - RNA, 1410 nt, Artificial Sequence; identical to SEQ ID NO: 108250
  derived and/or modified sequence opt2 from neuraminidase__InfluenzaA__ADB89564

SEQ ID NO: 109502 - RNA, 1410 nt, Artificial Sequence; identical to SEQ ID NO: 108250
  derived and/or modified sequence opt2 from neuraminidase__InfluenzaA__ADB89574

SEQ ID NO: 109503 - RNA, 1410 nt, Artificial Sequence; identical to SEQ ID NO: 108250
  derived and/or modified sequence opt2 from neuraminidase__InfluenzaA__ADB89594

SEQ ID NO: 109504 - RNA, 1410 nt, Artificial Sequence; identical to SEQ ID NO: 108250
  derived and/or modified sequence opt2 from neuraminidase__InfluenzaA__ADB89604

SEQ ID NO: 109505 - RNA, 1410 nt, Artificial Sequence
  derived and/or modified sequence opt2 from neuraminidase__InfluenzaA__ADB89614
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcaucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109506 - RNA, 1410 nt, Artificial Sequence; identical to SEQ ID NO: 108250
  derived and/or modified sequence opt2 from neuraminidase__InfluenzaA__ADB89624

SEQ ID NO: 109507 - RNA, 1410 nt, Artificial Sequence; identical to SEQ ID NO: 108250
  derived and/or modified sequence opt2 from neuraminidase__InfluenzaA__ADB89634

SEQ ID NO: 109508 - RNA, 1410 nt, Artificial Sequence; identical to SEQ ID NO: 108250
  derived and/or modified sequence opt2 from neuraminidase__InfluenzaA__ADB89644

SEQ ID NO: 109509 - RNA, 1410 nt, Artificial Sequence; identical to SEQ ID NO: 109268
  derived and/or modified sequence opt2 from neuraminidase__InfluenzaA__ADB89664

SEQ ID NO: 109510 - RNA, 1410 nt, Artificial Sequence; identical to SEQ ID NO: 108250
  derived and/or modified sequence opt2 from neuraminidase__InfluenzaA__ADB89674

SEQ ID NO: 109511 - RNA, 1410 nt, Artificial Sequence; identical to SEQ ID NO: 108250
  derived and/or modified sequence opt2 from neuraminidase__InfluenzaA__ADB89684

SEQ ID NO: 109512 - RNA, 1410 nt, Artificial Sequence
  derived and/or modified sequence opt2 from neuraminidase__InfluenzaA__ADB89694
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucaccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109513 - RNA, 1410 nt, Artificial Sequence; identical to SEQ ID NO: 108250
  derived and/or modified sequence opt2 from neuraminidase__InfluenzaA__ADB89704

SEQ ID NO: 109514 - RNA, 1410 nt, Artificial Sequence; identical to SEQ ID NO: 108250
  derived and/or modified sequence opt2 from neuraminidase__InfluenzaA__ADB89714

SEQ ID NO: 109515 - RNA, 1410 nt, Artificial Sequence; identical to SEQ ID NO: 108111
  derived and/or modified sequence opt2 from neuraminidase__InfluenzaA__ADB89724

SEQ ID NO: 109516 - RNA, 1410 nt, Artificial Sequence; identical to SEQ ID NO: 108111
  derived and/or modified sequence opt2 from neuraminidase__InfluenzaA__ADB89735

SEQ ID NO: 109517 - RNA, 1410 nt, Artificial Sequence; identical to SEQ ID NO: 108250
  derived and/or modified sequence opt2 from neuraminidase__InfluenzaA__ADB90357

SEQ ID NO: 109518 - RNA, 1410 nt, Artificial Sequence; identical to SEQ ID NO: 108250
  derived and/or modified sequence opt2 from neuraminidase__InfluenzaA__ADB90358

SEQ ID NO: 109519 - RNA, 1410 nt, Artificial Sequence
  derived and/or modified sequence opt2 from neuraminidase__InfluenzaA__ADB90359
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109520 - RNA, 1410 nt, Artificial Sequence; identical to SEQ ID NO: 108250
  derived and/or modified sequence opt2 from neuraminidase__InfluenzaA__ADB90363

SEQ ID NO: 109521 - RNA, 1410 nt, Artificial Sequence; identical to SEQ ID NO: 109427
  derived and/or modified sequence opt2 from neuraminidase__InfluenzaA__ADB90373

SEQ ID NO: 109522 - RNA, 1410 nt, Artificial Sequence; identical to SEQ ID NO: 108250
  derived and/or modified sequence opt2 from neuraminidase__InfluenzaA__ADB98137

SEQ ID NO: 109523 - RNA, 1410 nt, Artificial Sequence; identical to SEQ ID NO: 108604
  derived and/or modified sequence opt2 from neuraminidase__InfluenzaA__ADB98138

SEQ ID NO: 109524 - RNA, 1410 nt, Artificial Sequence; identical to SEQ ID NO: 108250
  derived and/or modified sequence opt2 from neuraminidase__InfluenzaA__ADB98139

SEQ ID NO: 109525 - RNA, 1410 nt, Artificial Sequence; identical to SEQ ID NO: 108604
  derived and/or modified sequence opt2 from neuraminidase__InfluenzaA__ADB98140

SEQ ID NO: 109526 - RNA, 1410 nt, Artificial Sequence; identical to SEQ ID NO: 108604
  derived and/or modified sequence opt2 from neuraminidase__InfluenzaA__ADB98141

SEQ ID NO: 109527 - RNA, 1410 nt, Artificial Sequence; identical to SEQ ID NO: 108250
  derived and/or modified sequence opt2 from neuraminidase__InfluenzaA__ADC32391

SEQ ID NO: 109528 - RNA, 1410 nt, Artificial Sequence; identical to SEQ ID NO: 108250
  derived and/or modified sequence opt2 from neuraminidase__InfluenzaA__ADC32392

SEQ ID NO: 109529 - RNA, 1410 nt, Artificial Sequence; identical to SEQ ID NO: 108250
  derived and/or modified sequence opt2 from neuraminidase__InfluenzaA__ADC32393

SEQ ID NO: 109530 - RNA, 1410 nt, Artificial Sequence; identical to SEQ ID NO: 108250
  derived and/or modified sequence opt2 from neuraminidase__InfluenzaA__ADC32394

SEQ ID NO: 109531 - RNA, 1410 nt, Artificial Sequence; identical to SEQ ID NO: 108250
  derived and/or modified sequence opt2 from neuraminidase__InfluenzaA__ADC32395

SEQ ID NO: 109532 - RNA, 1410 nt, Artificial Sequence; identical to SEQ ID NO: 108250
  derived and/or modified sequence opt2 from neuraminidase__InfluenzaA__ADC32396

SEQ ID NO: 109533 - RNA, 1410 nt, Artificial Sequence; identical to SEQ ID NO: 108250
  derived and/or modified sequence opt2 from neuraminidase__InfluenzaA__ADC32397

SEQ ID NO: 109534 - RNA, 1410 nt, Artificial Sequence; identical to SEQ ID NO: 108250
  derived and/or modified sequence opt2 from neuraminidase__InfluenzaA__ADC32398

SEQ ID NO: 109535 - RNA, 1410 nt, Artificial Sequence; identical to SEQ ID NO: 108250
  derived and/or modified sequence opt2 from neuraminidase__InfluenzaA__ADC32399

SEQ ID NO: 109536 - RNA, 1410 nt, Artificial Sequence; identical to SEQ ID NO: 108250
  derived and/or modified sequence opt2 from neuraminidase__InfluenzaA__ADC32400

SEQ ID NO: 109537 - RNA, 1410 nt, Artificial Sequence; identical to SEQ ID NO: 108250
  derived and/or modified sequence opt2 from neuraminidase__InfluenzaA__ADC32401

SEQ ID NO: 109538 - RNA, 1410 nt, Artificial Sequence
  derived and/or modified sequence opt2 from neuraminidase__InfluenzaA__ADC32404
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109539 - RNA, 1410 nt, Artificial Sequence
  derived and/or modified sequence opt2 from neuraminidase__InfluenzaA__ADC32407
augaaccccaagcagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109540 - RNA, 1410 nt, Artificial Sequence
  derived and/or modified sequence opt2 from neuraminidase__InfluenzaA__ADC34942
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcgagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaugaaggacuacuccaucgucuccuccuacgucugcuccggccucgucggcgacaccccccgcaagaacgacuccuccuccuccggccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 109541 - RNA, 1410 nt, Artificial Sequence
  derived and/or modified sequence opt2 from neuraminidase__InfluenzaA__ADC39000
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaacgucggcugguccuggcccgacggcgccgagcuccccuucaccaucgacaaguga

SEQ ID NO: 109542 - RNA, 1410 nt, Artificial Sequence; identical to SEQ ID NO: 108250
  derived and/or modified sequence opt2 from neuraminidase__InfluenzaA__ADC39010

SEQ ID NO: 109543 - RNA, 1413 nt, Artificial Sequence; identical to SEQ ID NO: 108144
  derived and/or modified sequence opt2 from neuraminidase__InfluenzaA__ADC45606

SEQ ID NO: 109544 - RNA, 1413 nt, Artificial Sequence
  derived and/or modified sequence opt2 from neuraminidase__InfluenzaA__ADC45628
augaaccccaaccagaagaucaucaccaucggcuccaucuccaucgccaucggcaucaucucccucaugcuccagaugggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 109545 - RNA, 1413 nt, Artificial Sequence
  derived and/or modified sequence opt2 from neuraminidase__InfluenzaA__ADC45639
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcgucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 109546 - RNA, 1413 nt, Artificial Sequence; identical to SEQ ID NO: 108144
  derived and/or modified sequence opt2 from neuraminidase__InfluenzaA__ADC45650

SEQ ID NO: 109547 - RNA, 1413 nt, Artificial Sequence; identical to SEQ ID NO: 108144
  derived and/or modified sequence opt2 from neuraminidase__InfluenzaA__ADC45661

SEQ ID NO: 109548 - RNA, 1413 nt, Artificial Sequence
  derived and/or modified sequence opt2 from neuraminidase__InfluenzaA__ADC45683
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcgaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 109549 - RNA, 1413 nt, Artificial Sequence
  derived and/or modified sequence opt2 from neuraminidase__InfluenzaA__ADC45705
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaagaaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109550 - RNA, 1413 nt, Artificial Sequence
  derived and/or modified sequence opt2 from neuraminidase__InfluenzaA__ADC45716
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucgagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccaacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 109551 - RNA, 1413 nt, Artificial Sequence
  derived and/or modified sequence opt2 from neuraminidase__InfluenzaA__ADC45738
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109552 - RNA, 1413 nt, Artificial Sequence
  derived and/or modified sequence opt2 from neuraminidase__InfluenzaA__ADC45760
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucggcugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109553 - RNA, 1413 nt, Artificial Sequence
  derived and/or modified sequence opt2 from neuraminidase__InfluenzaA__ADC45771
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccaugaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109554 - RNA, 1413 nt, Artificial Sequence
  derived and/or modified sequence opt2 from neuraminidase__InfluenzaA__ADC45782
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaaccgcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcgucaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109555 - RNA, 1413 nt, Artificial Sequence
  derived and/or modified sequence opt2 from neuraminidase__InfluenzaA__ADC45804
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaagaucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109556 - RNA, 1413 nt, Artificial Sequence
  derived and/or modified sequence opt2 from neuraminidase__InfluenzaA__ADC45815
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccgucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcauggucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109557 - RNA, 1413 nt, Artificial Sequence; identical to SEQ ID NO: 108973
  derived and/or modified sequence opt2 from neuraminidase__InfluenzaA__ADC45837

SEQ ID NO: 109558 - RNA, 1413 nt, Artificial Sequence; identical to SEQ ID NO: 108973
  derived and/or modified sequence opt2 from neuraminidase__InfluenzaA__ADC45848

SEQ ID NO: 109559 - RNA, 1410 nt, Artificial Sequence; identical to SEQ ID NO: 108250
  derived and/or modified sequence opt2 from neuraminidase__InfluenzaA__ADC53559

SEQ ID NO: 109560 - RNA, 1410 nt, Artificial Sequence; identical to SEQ ID NO: 108250
  derived and/or modified sequence opt2 from neuraminidase__InfluenzaA__ADD14088

SEQ ID NO: 109561 - RNA, 1410 nt, Artificial Sequence; identical to SEQ ID NO: 108250
  derived and/or modified sequence opt2 from neuraminidase__InfluenzaA__ADD14090

SEQ ID NO: 109562 - RNA, 1410 nt, Artificial Sequence; identical to SEQ ID NO: 108250
  derived and/or modified sequence opt2 from neuraminidase__InfluenzaA__ADD14094

SEQ ID NO: 109563 - RNA, 1410 nt, Artificial Sequence; identical to SEQ ID NO: 108250
  derived and/or modified sequence opt2 from neuraminidase__InfluenzaA__ADD14096

SEQ ID NO: 109564 - RNA, 1410 nt, Artificial Sequence; identical to SEQ ID NO: 108250
  derived and/or modified sequence opt2 from neuraminidase__InfluenzaA__ADD14098

SEQ ID NO: 109565 - RNA, 1410 nt, Artificial Sequence; identical to SEQ ID NO: 108250
  derived and/or modified sequence opt2 from neuraminidase__InfluenzaA__ADD14100

SEQ ID NO: 109566 - RNA, 1410 nt, Artificial Sequence; identical to SEQ ID NO: 108250
  derived and/or modified sequence opt2 from neuraminidase__InfluenzaA__ADD14102

SEQ ID NO: 109567 - RNA, 1410 nt, Artificial Sequence; identical to SEQ ID NO: 108250
  derived and/or modified sequence opt2 from neuraminidase__InfluenzaA__ADD14104

SEQ ID NO: 109568 - RNA, 1410 nt, Artificial Sequence; identical to SEQ ID NO: 108250
  derived and/or modified sequence opt2 from neuraminidase__InfluenzaA__ADD14106

SEQ ID NO: 109569 - RNA, 1410 nt, Artificial Sequence; identical to SEQ ID NO: 108250
  derived and/or modified sequence opt2 from neuraminidase__InfluenzaA__ADD14110

SEQ ID NO: 109570 - RNA, 1410 nt, Artificial Sequence; identical to SEQ ID NO: 108250
  derived and/or modified sequence opt2 from neuraminidase__InfluenzaA__ADD14112

SEQ ID NO: 109571 - RNA, 1410 nt, Artificial Sequence; identical to SEQ ID NO: 109220
  derived and/or modified sequence opt2 from neuraminidase__InfluenzaA__ADD14114

SEQ ID NO: 109572 - RNA, 1410 nt, Artificial Sequence; identical to SEQ ID NO: 108250
  derived and/or modified sequence opt2 from neuraminidase__InfluenzaA__ADD14116

SEQ ID NO: 109573 - RNA, 1410 nt, Artificial Sequence; identical to SEQ ID NO: 108250
  derived and/or modified sequence opt2 from neuraminidase__InfluenzaA__ADD14118

SEQ ID NO: 109574 - RNA, 1410 nt, Artificial Sequence; identical to SEQ ID NO: 108250
  derived and/or modified sequence opt2 from neuraminidase__InfluenzaA__ADD14120

SEQ ID NO: 109575 - RNA, 1410 nt, Artificial Sequence; identical to SEQ ID NO: 108250
  derived and/or modified sequence opt2 from neuraminidase__InfluenzaA__ADD14122

SEQ ID NO: 109576 - RNA, 1410 nt, Artificial Sequence; identical to SEQ ID NO: 108250
  derived and/or modified sequence opt2 from neuraminidase__InfluenzaA__ADD14124

SEQ ID NO: 109577 - RNA, 1410 nt, Artificial Sequence; identical to SEQ ID NO: 109309
  derived and/or modified sequence opt2 from neuraminidase__InfluenzaA__ADD14126

SEQ ID NO: 109578 - RNA, 1410 nt, Artificial Sequence; identical to SEQ ID NO: 108250
  derived and/or modified sequence opt2 from neuraminidase__InfluenzaA__ADD14128

SEQ ID NO: 109579 - RNA, 1410 nt, Artificial Sequence; identical to SEQ ID NO: 108250
  derived and/or modified sequence opt2 from neuraminidase__InfluenzaA__ADD14130

SEQ ID NO: 109580 - RNA, 1410 nt, Artificial Sequence; identical to SEQ ID NO: 108250
  derived and/or modified sequence opt2 from neuraminidase__InfluenzaA__ADD14132

SEQ ID NO: 109581 - RNA, 1410 nt, Artificial Sequence; identical to SEQ ID NO: 108250
  derived and/or modified sequence opt2 from neuraminidase__InfluenzaA__ADD14134

SEQ ID NO: 109582 - RNA, 1410 nt, Artificial Sequence; identical to SEQ ID NO: 108250
  derived and/or modified sequence opt2 from neuraminidase__InfluenzaA__ADD14136

SEQ ID NO: 109583 - RNA, 1410 nt, Artificial Sequence; identical to SEQ ID NO: 108250
  derived and/or modified sequence opt2 from neuraminidase__InfluenzaA__ADD14138

SEQ ID NO: 109584 - RNA, 1410 nt, Artificial Sequence; identical to SEQ ID NO: 108250
  derived and/or modified sequence opt2 from neuraminidase__InfluenzaA__ADD14142

SEQ ID NO: 109585 - RNA, 1410 nt, Artificial Sequence; identical to SEQ ID NO: 108250
  derived and/or modified sequence opt2 from neuraminidase__InfluenzaA__ADD14144

SEQ ID NO: 109586 - RNA, 1410 nt, Artificial Sequence; identical to SEQ ID NO: 108250
  derived and/or modified sequence opt2 from neuraminidase__InfluenzaA__ADD14146

SEQ ID NO: 109587 - RNA, 1410 nt, Artificial Sequence; identical to SEQ ID NO: 108250
  derived and/or modified sequence opt2 from neuraminidase__InfluenzaA__ADD14148

SEQ ID NO: 109588 - RNA, 1410 nt, Artificial Sequence
  derived and/or modified sequence opt2 from neuraminidase__InfluenzaA__ADD14150
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacgacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109589 - RNA, 1410 nt, Artificial Sequence; identical to SEQ ID NO: 108250
  derived and/or modified sequence opt2 from neuraminidase__InfluenzaA__ADD14152

SEQ ID NO: 109590 - RNA, 1410 nt, Artificial Sequence
  derived and/or modified sequence opt2 from neuraminidase__InfluenzaA__ADD14154
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaucaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109591 - RNA, 1410 nt, Artificial Sequence; identical to SEQ ID NO: 108250
  derived and/or modified sequence opt2 from neuraminidase__InfluenzaA__ADD14156

SEQ ID NO: 109592 - RNA, 1410 nt, Artificial Sequence; identical to SEQ ID NO: 108250
  derived and/or modified sequence opt2 from neuraminidase__InfluenzaA__ADD14158

SEQ ID NO: 109593 - RNA, 1410 nt, Artificial Sequence; identical to SEQ ID NO: 108250
  derived and/or modified sequence opt2 from neuraminidase__InfluenzaA__ADD14164

SEQ ID NO: 109594 - RNA, 1410 nt, Artificial Sequence; identical to SEQ ID NO: 108250
  derived and/or modified sequence opt2 from neuraminidase__InfluenzaA__ADD14174

SEQ ID NO: 109595 - RNA, 1410 nt, Artificial Sequence; identical to SEQ ID NO: 108250
  derived and/or modified sequence opt2 from neuraminidase__InfluenzaA__ADD14184

SEQ ID NO: 109596 - RNA, 1410 nt, Artificial Sequence; identical to SEQ ID NO: 108250
  derived and/or modified sequence opt2 from neuraminidase__InfluenzaA__ADD14194

SEQ ID NO: 109597 - RNA, 1410 nt, Artificial Sequence; identical to SEQ ID NO: 108604
  derived and/or modified sequence opt2 from neuraminidase__InfluenzaA__ADD14204

SEQ ID NO: 109598 - RNA, 1410 nt, Artificial Sequence
  derived and/or modified sequence opt2 from neuraminidase__InfluenzaA__ADD21449
augaaccccaaccagcgcaucaucaccaucggcaccgccugccucaucaucggcaucgucucccuccuccuccagaucggcaacaucgucucccucuggaucucccacuccauccagaccggcgagaagaaccacuccgagaccugcaaccgcaacaccaucaccuacgagaacuccaccugggucaaccagaccuacgucaacaucuccaacaucaacaucgccggcggccagggcgucgccuccaucauccucgccggcaacuccucccucugccccgucaacggcugggccaucuacuccaaggacaacuccauccgcaucggcuccaagggcgacaucuucgucauccgcgagcccuucaucuccugcucccaccucgagugccgcaccuucuuccucacccagggcgcccuccucaacgaccgccacuccaacggcaccgucaaggaccgcucccccuaccgcacccucauguccugccccaucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgacaccaucaaguccuggcgcaaccgcauccuccgcacccaggaguccgagugcgucugcaucaacggcuccugcuucaccaucaugaccgacggccccuccaacggccaggccuccuacaagaucuucaagauggagcgcggcaagaucaucaaguccgucgagcucgacgcccccaacuaccacuacgaggagugcuccugcuaccccgacaccggcaaggucgucugcgucugccgcgacaacuggcacgccuccaaccgccccugggucuccuucgaccagaaccucgacuaccagaucggcuacaucuccuccggcgucuucggcgacaacccccgcuccaacgacggcaagggcaacugcggccccguccucuccaacggcgccaacggcgucaagggccucuccuuccgcuacggcaacggcgucuggaucggccgcaccaaguccaccaacucccgcuccggcuucgagaugaucugggaccccaacggcuggaccgagaccgacuccaacuucuccaugaagcaggacaucaucgcccucaccgacugguccggcuacuccggcuccuucguccagcaccccgagcucaccggcaugaacugcauccgccccugcuucugggucgagcucauccgcggccagcccaagcaguccaccaucuggaccuccggcuccuccaucuccuucugcggcgucgacuccgagaccgccuccugguccuggcccgacggcgccgaccuccccuucaccaucgacaaguga

SEQ ID NO: 109599 - RNA, 1413 nt, Artificial Sequence
  derived and/or modified sequence opt2 from neuraminidase__InfluenzaA__ADD21469
augaaccccaaccagaagaucaucaccaucggcuccaucuccaucgccaucggcaucaucucccucaugcuccagaucggcaacaucaucuccgucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcaugcuccgcacccaggaguccgagugcaucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccaacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 109600 - RNA, 1410 nt, Artificial Sequence; identical to SEQ ID NO: 108250
  derived and/or modified sequence opt2 from neuraminidase__InfluenzaA__ADD21747

SEQ ID NO: 109601 - RNA, 1410 nt, Artificial Sequence
  derived and/or modified sequence opt2 from neuraminidase__InfluenzaA__ADD21767
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109602 - RNA, 1410 nt, Artificial Sequence
  derived and/or modified sequence opt2 from neuraminidase__InfluenzaA__ADD21777
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccgucaucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109603 - RNA, 1410 nt, Artificial Sequence; identical to SEQ ID NO: 108250
  derived and/or modified sequence opt2 from neuraminidase__InfluenzaA__ADD21787

SEQ ID NO: 109604 - RNA, 1410 nt, Artificial Sequence; identical to SEQ ID NO: 108250
  derived and/or modified sequence opt2 from neuraminidase__InfluenzaA__ADD21797

SEQ ID NO: 109605 - RNA, 1410 nt, Artificial Sequence; identical to SEQ ID NO: 108250
  derived and/or modified sequence opt2 from neuraminidase__InfluenzaA__ADD21817

SEQ ID NO: 109606 - RNA, 1410 nt, Artificial Sequence; identical to SEQ ID NO: 108250
  derived and/or modified sequence opt2 from neuraminidase__InfluenzaA__ADD21827

SEQ ID NO: 109607 - RNA, 1410 nt, Artificial Sequence; identical to SEQ ID NO: 108250
  derived and/or modified sequence opt2 from neuraminidase__InfluenzaA__ADD21837

SEQ ID NO: 109608 - RNA, 1410 nt, Artificial Sequence; identical to SEQ ID NO: 108250
  derived and/or modified sequence opt2 from neuraminidase__InfluenzaA__ADD21847

SEQ ID NO: 109609 - RNA, 1410 nt, Artificial Sequence; identical to SEQ ID NO: 108250
  derived and/or modified sequence opt2 from neuraminidase__InfluenzaA__ADD21857

SEQ ID NO: 109610 - RNA, 1410 nt, Artificial Sequence; identical to SEQ ID NO: 108250
  derived and/or modified sequence opt2 from neuraminidase__InfluenzaA__ADD21867

SEQ ID NO: 109611 - RNA, 1410 nt, Artificial Sequence; identical to SEQ ID NO: 108250
  derived and/or modified sequence opt2 from neuraminidase__InfluenzaA__ADD21877

SEQ ID NO: 109612 - RNA, 1410 nt, Artificial Sequence; identical to SEQ ID NO: 108250
  derived and/or modified sequence opt2 from neuraminidase__InfluenzaA__ADD21897

SEQ ID NO: 109613 - RNA, 1410 nt, Artificial Sequence; identical to SEQ ID NO: 108250
  derived and/or modified sequence opt2 from neuraminidase__InfluenzaA__ADD22494

SEQ ID NO: 109614 - RNA, 1410 nt, Artificial Sequence; identical to SEQ ID NO: 108250
  derived and/or modified sequence opt2 from neuraminidase__InfluenzaA__ADD22504

SEQ ID NO: 109615 - RNA, 1410 nt, Artificial Sequence; identical to SEQ ID NO: 108250
  derived and/or modified sequence opt2 from neuraminidase__InfluenzaA__ADD22514

SEQ ID NO: 109616 - RNA, 1410 nt, Artificial Sequence; identical to SEQ ID NO: 108250
  derived and/or modified sequence opt2 from neuraminidase__InfluenzaA__ADD22524

SEQ ID NO: 109617 - RNA, 1410 nt, Artificial Sequence
  derived and/or modified sequence opt2 from neuraminidase__InfluenzaA__ADD22534
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacuccccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109618 - RNA, 1410 nt, Artificial Sequence; identical to SEQ ID NO: 108250
  derived and/or modified sequence opt2 from neuraminidase__InfluenzaA__ADD22544

SEQ ID NO: 109619 - RNA, 1410 nt, Artificial Sequence; identical to SEQ ID NO: 108250
  derived and/or modified sequence opt2 from neuraminidase__InfluenzaA__ADD22557

SEQ ID NO: 109620 - RNA, 1410 nt, Artificial Sequence; identical to SEQ ID NO: 108250
  derived and/or modified sequence opt2 from neuraminidase__InfluenzaA__ADD22567

SEQ ID NO: 109621 - RNA, 1410 nt, Artificial Sequence; identical to SEQ ID NO: 108250
  derived and/or modified sequence opt2 from neuraminidase__InfluenzaA__ADD22577

SEQ ID NO: 109622 - RNA, 1410 nt, Artificial Sequence; identical to SEQ ID NO: 108250
  derived and/or modified sequence opt2 from neuraminidase__InfluenzaA__ADD22587

SEQ ID NO: 109623 - RNA, 1410 nt, Artificial Sequence; identical to SEQ ID NO: 108250
  derived and/or modified sequence opt2 from neuraminidase__InfluenzaA__ADD22597

SEQ ID NO: 109624 - RNA, 1410 nt, Artificial Sequence; identical to SEQ ID NO: 108250
  derived and/or modified sequence opt2 from neuraminidase__InfluenzaA__ADD22617

SEQ ID NO: 109625 - RNA, 1410 nt, Artificial Sequence; identical to SEQ ID NO: 108250
  derived and/or modified sequence opt2 from neuraminidase__InfluenzaA__ADD22627

SEQ ID NO: 109626 - RNA, 1410 nt, Artificial Sequence; identical to SEQ ID NO: 108250
  derived and/or modified sequence opt2 from neuraminidase__InfluenzaA__ADD22637

SEQ ID NO: 109627 - RNA, 1410 nt, Artificial Sequence; identical to SEQ ID NO: 108250
  derived and/or modified sequence opt2 from neuraminidase__InfluenzaA__ADD22648

SEQ ID NO: 109628 - RNA, 1410 nt, Artificial Sequence; identical to SEQ ID NO: 108250
  derived and/or modified sequence opt2 from neuraminidase__InfluenzaA__ADD22658

SEQ ID NO: 109629 - RNA, 1410 nt, Artificial Sequence; identical to SEQ ID NO: 108250
  derived and/or modified sequence opt2 from neuraminidase__InfluenzaA__ADD22668

SEQ ID NO: 109630 - RNA, 1410 nt, Artificial Sequence
  derived and/or modified sequence opt2 from neuraminidase__InfluenzaA__ADD22688
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucuggaucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109631 - RNA, 1410 nt, Artificial Sequence; identical to SEQ ID NO: 108250
  derived and/or modified sequence opt2 from neuraminidase__InfluenzaA__ADD22698

SEQ ID NO: 109632 - RNA, 1410 nt, Artificial Sequence; identical to SEQ ID NO: 108250
  derived and/or modified sequence opt2 from neuraminidase__InfluenzaA__ADD22725

SEQ ID NO: 109633 - RNA, 1410 nt, Artificial Sequence; identical to SEQ ID NO: 108250
  derived and/or modified sequence opt2 from neuraminidase__InfluenzaA__ADD22735

SEQ ID NO: 109634 - RNA, 1410 nt, Artificial Sequence; identical to SEQ ID NO: 108250
  derived and/or modified sequence opt2 from neuraminidase__InfluenzaA__ADD22745

SEQ ID NO: 109635 - RNA, 1410 nt, Artificial Sequence
  derived and/or modified sequence opt2 from neuraminidase__InfluenzaA__ADD22755
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugcaccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacuccccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109636 - RNA, 1410 nt, Artificial Sequence
  derived and/or modified sequence opt2 from neuraminidase__InfluenzaA__ADD22765
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgacugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109637 - RNA, 1410 nt, Artificial Sequence; identical to SEQ ID NO: 108250
  derived and/or modified sequence opt2 from neuraminidase__InfluenzaA__ADD22775

SEQ ID NO: 109638 - RNA, 1410 nt, Artificial Sequence; identical to SEQ ID NO: 108250
  derived and/or modified sequence opt2 from neuraminidase__InfluenzaA__ADD22785

SEQ ID NO: 109639 - RNA, 1410 nt, Artificial Sequence; identical to SEQ ID NO: 108250
  derived and/or modified sequence opt2 from neuraminidase__InfluenzaA__ADD22795

SEQ ID NO: 109640 - RNA, 1410 nt, Artificial Sequence; identical to SEQ ID NO: 108250
  derived and/or modified sequence opt2 from neuraminidase__InfluenzaA__ADD22805

SEQ ID NO: 109641 - RNA, 1410 nt, Artificial Sequence; identical to SEQ ID NO: 108250
  derived and/or modified sequence opt2 from neuraminidase__InfluenzaA__ADD22815

SEQ ID NO: 109642 - RNA, 1410 nt, Artificial Sequence; identical to SEQ ID NO: 108250
  derived and/or modified sequence opt2 from neuraminidase__InfluenzaA__ADD22825

SEQ ID NO: 109643 - RNA, 1410 nt, Artificial Sequence; identical to SEQ ID NO: 108250
  derived and/or modified sequence opt2 from neuraminidase__InfluenzaA__ADD22835

SEQ ID NO: 109644 - RNA, 1410 nt, Artificial Sequence; identical to SEQ ID NO: 108250
  derived and/or modified sequence opt2 from neuraminidase__InfluenzaA__ADD22845

SEQ ID NO: 109645 - RNA, 1410 nt, Artificial Sequence; identical to SEQ ID NO: 108250
  derived and/or modified sequence opt2 from neuraminidase__InfluenzaA__ADD22855

SEQ ID NO: 109646 - RNA, 1410 nt, Artificial Sequence; identical to SEQ ID NO: 108250
  derived and/or modified sequence opt2 from neuraminidase__InfluenzaA__ADD22924

SEQ ID NO: 109647 - RNA, 1410 nt, Artificial Sequence; identical to SEQ ID NO: 108250
  derived and/or modified sequence opt2 from neuraminidase__InfluenzaA__ADD22934

SEQ ID NO: 109648 - RNA, 1410 nt, Artificial Sequence; identical to SEQ ID NO: 108250
  derived and/or modified sequence opt2 from neuraminidase__InfluenzaA__ADD22944

SEQ ID NO: 109649 - RNA, 1410 nt, Artificial Sequence; identical to SEQ ID NO: 108250
  derived and/or modified sequence opt2 from neuraminidase__InfluenzaA__ADD22954

SEQ ID NO: 109650 - RNA, 1410 nt, Artificial Sequence; identical to SEQ ID NO: 108250
  derived and/or modified sequence opt2 from neuraminidase__InfluenzaA__ADD22974

SEQ ID NO: 109651 - RNA, 1410 nt, Artificial Sequence; identical to SEQ ID NO: 108250
  derived and/or modified sequence opt2 from neuraminidase__InfluenzaA__ADD23075

SEQ ID NO: 109652 - RNA, 1410 nt, Artificial Sequence
  derived and/or modified sequence opt2 from neuraminidase__InfluenzaA__ADD23085
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcucuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109653 - RNA, 1410 nt, Artificial Sequence; identical to SEQ ID NO: 108250
  derived and/or modified sequence opt2 from neuraminidase__InfluenzaA__ADD23095

SEQ ID NO: 109654 - RNA, 1410 nt, Artificial Sequence; identical to SEQ ID NO: 108250
  derived and/or modified sequence opt2 from neuraminidase__InfluenzaA__ADD23105

SEQ ID NO: 109655 - RNA, 1410 nt, Artificial Sequence; identical to SEQ ID NO: 108250
  derived and/or modified sequence opt2 from neuraminidase__InfluenzaA__ADD23115

SEQ ID NO: 109656 - RNA, 1410 nt, Artificial Sequence; identical to SEQ ID NO: 108250
  derived and/or modified sequence opt2 from neuraminidase__InfluenzaA__ADD23125

SEQ ID NO: 109657 - RNA, 1410 nt, Artificial Sequence; identical to SEQ ID NO: 108250
  derived and/or modified sequence opt2 from neuraminidase__InfluenzaA__ADD23135

SEQ ID NO: 109658 - RNA, 1410 nt, Artificial Sequence; identical to SEQ ID NO: 108250
  derived and/or modified sequence opt2 from neuraminidase__InfluenzaA__ADD23145

SEQ ID NO: 109659 - RNA, 1410 nt, Artificial Sequence; identical to SEQ ID NO: 108250
  derived and/or modified sequence opt2 from neuraminidase__InfluenzaA__ADD23155

SEQ ID NO: 109660 - RNA, 1410 nt, Artificial Sequence; identical to SEQ ID NO: 108250
  derived and/or modified sequence opt2 from neuraminidase__InfluenzaA__ADD23165

SEQ ID NO: 109661 - RNA, 1410 nt, Artificial Sequence; identical to SEQ ID NO: 108250
  derived and/or modified sequence opt2 from neuraminidase__InfluenzaA__ADD23175

SEQ ID NO: 109662 - RNA, 1410 nt, Artificial Sequence; identical to SEQ ID NO: 108250
  derived and/or modified sequence opt2 from neuraminidase__InfluenzaA__ADD23185

SEQ ID NO: 109663 - RNA, 1410 nt, Artificial Sequence; identical to SEQ ID NO: 108250
  derived and/or modified sequence opt2 from neuraminidase__InfluenzaA__ADD23195

SEQ ID NO: 109664 - RNA, 1410 nt, Artificial Sequence; identical to SEQ ID NO: 108250
  derived and/or modified sequence opt2 from neuraminidase__InfluenzaA__ADD23223

SEQ ID NO: 109665 - RNA, 1410 nt, Artificial Sequence
  derived and/or modified sequence opt2 from neuraminidase__InfluenzaA__ADD23233
augaaccccaaccagaagaucaucaccaucggcuccgucugcaugaccaucggcauggccaaccucauccuccagaucggcaacaucaucuccaucuggaucggccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109666 - RNA, 1410 nt, Artificial Sequence; identical to SEQ ID NO: 108250
  derived and/or modified sequence opt2 from neuraminidase__InfluenzaA__ADD23243

SEQ ID NO: 109667 - RNA, 1410 nt, Artificial Sequence; identical to SEQ ID NO: 109538
  derived and/or modified sequence opt2 from neuraminidase__InfluenzaA__ADD23253

SEQ ID NO: 109668 - RNA, 1410 nt, Artificial Sequence
  derived and/or modified sequence opt2 from neuraminidase__InfluenzaA__ADD23273
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccgagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109669 - RNA, 1410 nt, Artificial Sequence; identical to SEQ ID NO: 108250
  derived and/or modified sequence opt2 from neuraminidase__InfluenzaA__ADD23283

SEQ ID NO: 109670 - RNA, 1410 nt, Artificial Sequence; identical to SEQ ID NO: 108250
  derived and/or modified sequence opt2 from neuraminidase__InfluenzaA__ADD23293

SEQ ID NO: 109671 - RNA, 1410 nt, Artificial Sequence; identical to SEQ ID NO: 108250
  derived and/or modified sequence opt2 from neuraminidase__InfluenzaA__ADD23303

SEQ ID NO: 109672 - RNA, 1410 nt, Artificial Sequence; identical to SEQ ID NO: 108250
  derived and/or modified sequence opt2 from neuraminidase__InfluenzaA__ADD23313

SEQ ID NO: 109673 - RNA, 1410 nt, Artificial Sequence
  derived and/or modified sequence opt2 from neuraminidase__InfluenzaA__ADD23323
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccguccucaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109674 - RNA, 1410 nt, Artificial Sequence; identical to SEQ ID NO: 108250
  derived and/or modified sequence opt2 from neuraminidase__InfluenzaA__ADD23333

SEQ ID NO: 109675 - RNA, 1410 nt, Artificial Sequence; identical to SEQ ID NO: 108250
  derived and/or modified sequence opt2 from neuraminidase__InfluenzaA__ADD23358

SEQ ID NO: 109676 - RNA, 1410 nt, Artificial Sequence; identical to SEQ ID NO: 109601
  derived and/or modified sequence opt2 from neuraminidase__InfluenzaA__ADD23368

SEQ ID NO: 109677 - RNA, 1410 nt, Artificial Sequence; identical to SEQ ID NO: 108250
  derived and/or modified sequence opt2 from neuraminidase__InfluenzaA__ADD23378

SEQ ID NO: 109678 - RNA, 1410 nt, Artificial Sequence; identical to SEQ ID NO: 108250
  derived and/or modified sequence opt2 from neuraminidase__InfluenzaA__ADD23388

SEQ ID NO: 109679 - RNA, 1410 nt, Artificial Sequence; identical to SEQ ID NO: 108833
  derived and/or modified sequence opt2 from neuraminidase__InfluenzaA__ADD23398

SEQ ID NO: 109680 - RNA, 1410 nt, Artificial Sequence
  derived and/or modified sequence opt2 from neuraminidase__InfluenzaA__ADD23408
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccaggaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109681 - RNA, 1410 nt, Artificial Sequence
  derived and/or modified sequence opt2 from neuraminidase__InfluenzaA__ADD23438
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109682 - RNA, 1410 nt, Artificial Sequence; identical to SEQ ID NO: 108250
  derived and/or modified sequence opt2 from neuraminidase__InfluenzaA__ADD23448

SEQ ID NO: 109683 - RNA, 1410 nt, Artificial Sequence; identical to SEQ ID NO: 108250
  derived and/or modified sequence opt2 from neuraminidase__InfluenzaA__ADD23458

SEQ ID NO: 109684 - RNA, 1410 nt, Artificial Sequence
  derived and/or modified sequence opt2 from neuraminidase__InfluenzaA__ADD23468
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcgucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109685 - RNA, 1410 nt, Artificial Sequence; identical to SEQ ID NO: 108250
  derived and/or modified sequence opt2 from neuraminidase__InfluenzaA__ADD23478

SEQ ID NO: 109686 - RNA, 1410 nt, Artificial Sequence; identical to SEQ ID NO: 108250
  derived and/or modified sequence opt2 from neuraminidase__InfluenzaA__ADD23488

SEQ ID NO: 109687 - RNA, 1410 nt, Artificial Sequence
  derived and/or modified sequence opt2 from neuraminidase__InfluenzaA__ADD23498
augaaccccaaccagaagaucaucaccaucggcuccgucugcaugaccaucggcauggccaaccucauccuccagaucggcaacaucaucuccaucuggaucucccacuccauccagcucggcaaccagaaccacaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109688 - RNA, 1410 nt, Artificial Sequence; identical to SEQ ID NO: 108250
  derived and/or modified sequence opt2 from neuraminidase__InfluenzaA__ADD23508

SEQ ID NO: 109689 - RNA, 1410 nt, Artificial Sequence; identical to SEQ ID NO: 108250
  derived and/or modified sequence opt2 from neuraminidase__InfluenzaA__ADD23518

SEQ ID NO: 109690 - RNA, 1410 nt, Artificial Sequence; identical to SEQ ID NO: 108250
  derived and/or modified sequence opt2 from neuraminidase__InfluenzaA__ADD23997

SEQ ID NO: 109691 - RNA, 1410 nt, Artificial Sequence; identical to SEQ ID NO: 108250
  derived and/or modified sequence opt2 from neuraminidase__InfluenzaA__ADD24007

SEQ ID NO: 109692 - RNA, 1410 nt, Artificial Sequence; identical to SEQ ID NO: 108250
  derived and/or modified sequence opt2 from neuraminidase__InfluenzaA__ADD24017

SEQ ID NO: 109693 - RNA, 1410 nt, Artificial Sequence; identical to SEQ ID NO: 108250
  derived and/or modified sequence opt2 from neuraminidase__InfluenzaA__ADD24024

SEQ ID NO: 109694 - RNA, 1410 nt, Artificial Sequence; identical to SEQ ID NO: 108250
  derived and/or modified sequence opt2 from neuraminidase__InfluenzaA__ADD24025

SEQ ID NO: 109695 - RNA, 1410 nt, Artificial Sequence; identical to SEQ ID NO: 108250
  derived and/or modified sequence opt2 from neuraminidase__InfluenzaA__ADD24026

SEQ ID NO: 109696 - RNA, 1410 nt, Artificial Sequence; identical to SEQ ID NO: 108250
  derived and/or modified sequence opt2 from neuraminidase__InfluenzaA__ADD24027

SEQ ID NO: 109697 - RNA, 1410 nt, Artificial Sequence; identical to SEQ ID NO: 108250
  derived and/or modified sequence opt2 from neuraminidase__InfluenzaA__ADD24028

SEQ ID NO: 109698 - RNA, 1410 nt, Artificial Sequence; identical to SEQ ID NO: 108250
  derived and/or modified sequence opt2 from neuraminidase__InfluenzaA__ADD24029

SEQ ID NO: 109699 - RNA, 1410 nt, Artificial Sequence; identical to SEQ ID NO: 108250
  derived and/or modified sequence opt2 from neuraminidase__InfluenzaA__ADD24030

SEQ ID NO: 109700 - RNA, 1410 nt, Artificial Sequence; identical to SEQ ID NO: 108250
  derived and/or modified sequence opt2 from neuraminidase__InfluenzaA__ADD24031

SEQ ID NO: 109701 - RNA, 1410 nt, Artificial Sequence; identical to SEQ ID NO: 108250
  derived and/or modified sequence opt2 from neuraminidase__InfluenzaA__ADD24032

SEQ ID NO: 109702 - RNA, 1410 nt, Artificial Sequence; identical to SEQ ID NO: 108250
  derived and/or modified sequence opt2 from neuraminidase__InfluenzaA__ADD25231

SEQ ID NO: 109703 - RNA, 1410 nt, Artificial Sequence; identical to SEQ ID NO: 108250
  derived and/or modified sequence opt2 from neuraminidase__InfluenzaA__ADD25233

SEQ ID NO: 109704 - RNA, 1410 nt, Artificial Sequence; identical to SEQ ID NO: 108250
  derived and/or modified sequence opt2 from neuraminidase__InfluenzaA__ADD25235

SEQ ID NO: 109705 - RNA, 1410 nt, Artificial Sequence; identical to SEQ ID NO: 108250
  derived and/or modified sequence opt2 from neuraminidase__InfluenzaA__ADD25244

SEQ ID NO: 109706 - RNA, 1410 nt, Artificial Sequence
  derived and/or modified sequence opt2 from neuraminidase__InfluenzaA__ADD25246
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaccaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109707 - RNA, 1410 nt, Artificial Sequence; identical to SEQ ID NO: 108250
  derived and/or modified sequence opt2 from neuraminidase__InfluenzaA__ADD25248

SEQ ID NO: 109708 - RNA, 1410 nt, Artificial Sequence
  derived and/or modified sequence opt2 from neuraminidase__InfluenzaA__ADD25250
augaaccccaaccagaagaucaucaccaucggcuccgucugcaugaccaucggcauggccaaccucauccuccagaucggcaacaucaucuccaucuggaucucccgcuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccaugggcugguccuggcccgacggcgccgagcuccccuucaccaucgacaaguga

SEQ ID NO: 109709 - RNA, 1410 nt, Artificial Sequence; identical to SEQ ID NO: 108250
  derived and/or modified sequence opt2 from neuraminidase__InfluenzaA__ADD25255

SEQ ID NO: 109710 - RNA, 1410 nt, Artificial Sequence; identical to SEQ ID NO: 108250
  derived and/or modified sequence opt2 from neuraminidase__InfluenzaA__ADD25259

SEQ ID NO: 109711 - RNA, 1410 nt, Artificial Sequence
  derived and/or modified sequence opt2 from neuraminidase__InfluenzaA__ADD25262
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccgacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109712 - RNA, 1410 nt, Artificial Sequence
  derived and/or modified sequence opt2 from neuraminidase__InfluenzaA__ADD25266
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109713 - RNA, 1410 nt, Artificial Sequence; identical to SEQ ID NO: 108250
  derived and/or modified sequence opt2 from neuraminidase__InfluenzaA__ADD25268

SEQ ID NO: 109714 - RNA, 1410 nt, Artificial Sequence; identical to SEQ ID NO: 108250
  derived and/or modified sequence opt2 from neuraminidase__InfluenzaA__ADD25271

SEQ ID NO: 109715 - RNA, 1410 nt, Artificial Sequence; identical to SEQ ID NO: 108250
  derived and/or modified sequence opt2 from neuraminidase__InfluenzaA__ADD25274

SEQ ID NO: 109716 - RNA, 1410 nt, Artificial Sequence; identical to SEQ ID NO: 108250
  derived and/or modified sequence opt2 from neuraminidase__InfluenzaA__ADD25276

SEQ ID NO: 109717 - RNA, 1410 nt, Artificial Sequence
  derived and/or modified sequence opt2 from neuraminidase__InfluenzaA__ADD25278
augaaccccaaccagaagaucaucaccaucggcuccgucugcaugaccaucggcauggccaaccucauccuccagaucggcaacaucaucuccaucuggaucucccgcuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109718 - RNA, 1410 nt, Artificial Sequence; identical to SEQ ID NO: 108250
  derived and/or modified sequence opt2 from neuraminidase__InfluenzaA__ADD25280

SEQ ID NO: 109719 - RNA, 1410 nt, Artificial Sequence; identical to SEQ ID NO: 108250
  derived and/or modified sequence opt2 from neuraminidase__InfluenzaA__ADD25282

SEQ ID NO: 109720 - RNA, 1410 nt, Artificial Sequence; identical to SEQ ID NO: 109538
  derived and/or modified sequence opt2 from neuraminidase__InfluenzaA__ADD25284

SEQ ID NO: 109721 - RNA, 1410 nt, Artificial Sequence; identical to SEQ ID NO: 108250
  derived and/or modified sequence opt2 from neuraminidase__InfluenzaA__ADD25287

SEQ ID NO: 109722 - RNA, 1410 nt, Artificial Sequence; identical to SEQ ID NO: 108250
  derived and/or modified sequence opt2 from neuraminidase__InfluenzaA__ADD25291

SEQ ID NO: 109723 - RNA, 1410 nt, Artificial Sequence; identical to SEQ ID NO: 109538
  derived and/or modified sequence opt2 from neuraminidase__InfluenzaA__ADD25293

SEQ ID NO: 109724 - RNA, 1410 nt, Artificial Sequence; identical to SEQ ID NO: 108250
  derived and/or modified sequence opt2 from neuraminidase__InfluenzaA__ADD25300

SEQ ID NO: 109725 - RNA, 1410 nt, Artificial Sequence
  derived and/or modified sequence opt2 from neuraminidase__InfluenzaA__ADD25304
augaaccccaaccagaagaucaucaccaucggcuccgucugcaugaccaucggcauggccaaccucauccuccagaucggcaacaucgucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109726 - RNA, 1410 nt, Artificial Sequence
  derived and/or modified sequence opt2 from neuraminidase__InfluenzaA__ADD25306
augaaccccaaccagaagaucaucaccaucggcuccgucugcaugaccaucggcauggccaaccucauccuccagaucggcaacaucaucuccaucuggaucucccgcuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacgagcccuccgacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109727 - RNA, 1410 nt, Artificial Sequence; identical to SEQ ID NO: 108250
  derived and/or modified sequence opt2 from neuraminidase__InfluenzaA__ADD25308

SEQ ID NO: 109728 - RNA, 1410 nt, Artificial Sequence; identical to SEQ ID NO: 108250
  derived and/or modified sequence opt2 from neuraminidase__InfluenzaA__ADD25310

SEQ ID NO: 109729 - RNA, 1410 nt, Artificial Sequence; identical to SEQ ID NO: 108250
  derived and/or modified sequence opt2 from neuraminidase__InfluenzaA__ADD25312

SEQ ID NO: 109730 - RNA, 1410 nt, Artificial Sequence; identical to SEQ ID NO: 108250
  derived and/or modified sequence opt2 from neuraminidase__InfluenzaA__ADD25314

SEQ ID NO: 109731 - RNA, 1410 nt, Artificial Sequence; identical to SEQ ID NO: 108250
  derived and/or modified sequence opt2 from neuraminidase__InfluenzaA__ADD25316

SEQ ID NO: 109732 - RNA, 1410 nt, Artificial Sequence; identical to SEQ ID NO: 108250
  derived and/or modified sequence opt2 from neuraminidase__InfluenzaA__ADD29799

SEQ ID NO: 109733 - RNA, 1410 nt, Artificial Sequence; identical to SEQ ID NO: 108250
  derived and/or modified sequence opt2 from neuraminidase__InfluenzaA__ADD29800

SEQ ID NO: 109734 - RNA, 1410 nt, Artificial Sequence; identical to SEQ ID NO: 108250
  derived and/or modified sequence opt2 from neuraminidase__InfluenzaA__ADD29801

SEQ ID NO: 109735 - RNA, 1410 nt, Artificial Sequence; identical to SEQ ID NO: 108250
  derived and/or modified sequence opt2 from neuraminidase__InfluenzaA__ADD29802

SEQ ID NO: 109736 - RNA, 1410 nt, Artificial Sequence; identical to SEQ ID NO: 108250
  derived and/or modified sequence opt2 from neuraminidase__InfluenzaA__ADD29803

SEQ ID NO: 109737 - RNA, 1410 nt, Artificial Sequence; identical to SEQ ID NO: 108250
  derived and/or modified sequence opt2 from neuraminidase__InfluenzaA__ADD29804

SEQ ID NO: 109738 - RNA, 1410 nt, Artificial Sequence; identical to SEQ ID NO: 108250
  derived and/or modified sequence opt2 from neuraminidase__InfluenzaA__ADD29805

SEQ ID NO: 109739 - RNA, 1410 nt, Artificial Sequence; identical to SEQ ID NO: 108250
  derived and/or modified sequence opt2 from neuraminidase__InfluenzaA__ADD29806

SEQ ID NO: 109740 - RNA, 1410 nt, Artificial Sequence; identical to SEQ ID NO: 108250
  derived and/or modified sequence opt2 from neuraminidase__InfluenzaA__ADD29807

SEQ ID NO: 109741 - RNA, 1410 nt, Artificial Sequence; identical to SEQ ID NO: 108250
  derived and/or modified sequence opt2 from neuraminidase__InfluenzaA__ADD29808

SEQ ID NO: 109742 - RNA, 1410 nt, Artificial Sequence; identical to SEQ ID NO: 108250
  derived and/or modified sequence opt2 from neuraminidase__InfluenzaA__ADD52538

SEQ ID NO: 109743 - RNA, 1410 nt, Artificial Sequence; identical to SEQ ID NO: 109473
  derived and/or modified sequence opt2 from neuraminidase__InfluenzaA__ADD74353

SEQ ID NO: 109744 - RNA, 1410 nt, Artificial Sequence; identical to SEQ ID NO: 108250
  derived and/or modified sequence opt2 from neuraminidase__InfluenzaA__ADD74373

SEQ ID NO: 109745 - RNA, 1410 nt, Artificial Sequence; identical to SEQ ID NO: 108250
  derived and/or modified sequence opt2 from neuraminidase__InfluenzaA__ADD74383

SEQ ID NO: 109746 - RNA, 1410 nt, Artificial Sequence; identical to SEQ ID NO: 108250
  derived and/or modified sequence opt2 from neuraminidase__InfluenzaA__ADD74401

SEQ ID NO: 109747 - RNA, 1410 nt, Artificial Sequence
  derived and/or modified sequence opt2 from neuraminidase__InfluenzaA__ADD74411
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacgucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcuccggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109748 - RNA, 1410 nt, Artificial Sequence; identical to SEQ ID NO: 108250
  derived and/or modified sequence opt2 from neuraminidase__InfluenzaA__ADD74421

SEQ ID NO: 109749 - RNA, 1410 nt, Artificial Sequence; identical to SEQ ID NO: 108250
  derived and/or modified sequence opt2 from neuraminidase__InfluenzaA__ADD74431

SEQ ID NO: 109750 - RNA, 1410 nt, Artificial Sequence
  derived and/or modified sequence opt2 from neuraminidase__InfluenzaA__ADD74441
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaucuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109751 - RNA, 1410 nt, Artificial Sequence; identical to SEQ ID NO: 108250
  derived and/or modified sequence opt2 from neuraminidase__InfluenzaA__ADD74451

SEQ ID NO: 109752 - RNA, 1410 nt, Artificial Sequence; identical to SEQ ID NO: 108250
  derived and/or modified sequence opt2 from neuraminidase__InfluenzaA__ADD74461

SEQ ID NO: 109753 - RNA, 1410 nt, Artificial Sequence; identical to SEQ ID NO: 108250
  derived and/or modified sequence opt2 from neuraminidase__InfluenzaA__ADD74471

SEQ ID NO: 109754 - RNA, 1410 nt, Artificial Sequence; identical to SEQ ID NO: 108250
  derived and/or modified sequence opt2 from neuraminidase__InfluenzaA__ADD74481

SEQ ID NO: 109755 - RNA, 1410 nt, Artificial Sequence; identical to SEQ ID NO: 109267
  derived and/or modified sequence opt2 from neuraminidase__InfluenzaA__ADD74491

SEQ ID NO: 109756 - RNA, 1410 nt, Artificial Sequence; identical to SEQ ID NO: 108250
  derived and/or modified sequence opt2 from neuraminidase__InfluenzaA__ADD74501

SEQ ID NO: 109757 - RNA, 1410 nt, Artificial Sequence; identical to SEQ ID NO: 108250
  derived and/or modified sequence opt2 from neuraminidase__InfluenzaA__ADD74511

SEQ ID NO: 109758 - RNA, 1410 nt, Artificial Sequence; identical to SEQ ID NO: 109268
  derived and/or modified sequence opt2 from neuraminidase__InfluenzaA__ADD74521

SEQ ID NO: 109759 - RNA, 1410 nt, Artificial Sequence; identical to SEQ ID NO: 108250
  derived and/or modified sequence opt2 from neuraminidase__InfluenzaA__ADD74531

SEQ ID NO: 109760 - RNA, 1410 nt, Artificial Sequence
  derived and/or modified sequence opt2 from neuraminidase__InfluenzaA__ADD74551
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109761 - RNA, 1410 nt, Artificial Sequence; identical to SEQ ID NO: 108250
  derived and/or modified sequence opt2 from neuraminidase__InfluenzaA__ADD74561

SEQ ID NO: 109762 - RNA, 1410 nt, Artificial Sequence; identical to SEQ ID NO: 108250
  derived and/or modified sequence opt2 from neuraminidase__InfluenzaA__ADD74571

SEQ ID NO: 109763 - RNA, 1410 nt, Artificial Sequence
  derived and/or modified sequence opt2 from neuraminidase__InfluenzaA__ADD74581
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacgccgucggcugguccuggcccgacggcgccgagcuccccuucaccaucgacaaguga

SEQ ID NO: 109764 - RNA, 1410 nt, Artificial Sequence; identical to SEQ ID NO: 108250
  derived and/or modified sequence opt2 from neuraminidase__InfluenzaA__ADD74591

SEQ ID NO: 109765 - RNA, 1410 nt, Artificial Sequence; identical to SEQ ID NO: 108250
  derived and/or modified sequence opt2 from neuraminidase__InfluenzaA__ADD74601

SEQ ID NO: 109766 - RNA, 1410 nt, Artificial Sequence
  derived and/or modified sequence opt2 from neuraminidase__InfluenzaA__ADD74611
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcaucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109767 - RNA, 1410 nt, Artificial Sequence; identical to SEQ ID NO: 108250
  derived and/or modified sequence opt2 from neuraminidase__InfluenzaA__ADD74621

SEQ ID NO: 109768 - RNA, 1410 nt, Artificial Sequence; identical to SEQ ID NO: 108250
  derived and/or modified sequence opt2 from neuraminidase__InfluenzaA__ADD74631

SEQ ID NO: 109769 - RNA, 1410 nt, Artificial Sequence; identical to SEQ ID NO: 108250
  derived and/or modified sequence opt2 from neuraminidase__InfluenzaA__ADD74641

SEQ ID NO: 109770 - RNA, 1410 nt, Artificial Sequence; identical to SEQ ID NO: 108250
  derived and/or modified sequence opt2 from neuraminidase__InfluenzaA__ADD74651

SEQ ID NO: 109771 - RNA, 1410 nt, Artificial Sequence; identical to SEQ ID NO: 109601
  derived and/or modified sequence opt2 from neuraminidase__InfluenzaA__ADD74661

SEQ ID NO: 109772 - RNA, 1410 nt, Artificial Sequence; identical to SEQ ID NO: 108250
  derived and/or modified sequence opt2 from neuraminidase__InfluenzaA__ADD74671

SEQ ID NO: 109773 - RNA, 1410 nt, Artificial Sequence; identical to SEQ ID NO: 108250
  derived and/or modified sequence opt2 from neuraminidase__InfluenzaA__ADD74681

SEQ ID NO: 109774 - RNA, 1410 nt, Artificial Sequence
  derived and/or modified sequence opt2 from neuraminidase__InfluenzaA__ADD74691
augaaccccaaccagaagaucaucaccaucggcuccgucugcaugaccaucggcauggccaaccucauccuccagaucggcaacaucaucuccaucuggaucugccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109775 - RNA, 1410 nt, Artificial Sequence; identical to SEQ ID NO: 108250
  derived and/or modified sequence opt2 from neuraminidase__InfluenzaA__ADD74701

SEQ ID NO: 109776 - RNA, 1410 nt, Artificial Sequence; identical to SEQ ID NO: 108250
  derived and/or modified sequence opt2 from neuraminidase__InfluenzaA__ADD74711

SEQ ID NO: 109777 - RNA, 1410 nt, Artificial Sequence; identical to SEQ ID NO: 108250
  derived and/or modified sequence opt2 from neuraminidase__InfluenzaA__ADD74721

SEQ ID NO: 109778 - RNA, 1410 nt, Artificial Sequence; identical to SEQ ID NO: 108250
  derived and/or modified sequence opt2 from neuraminidase__InfluenzaA__ADD74731

SEQ ID NO: 109779 - RNA, 1410 nt, Artificial Sequence
  derived and/or modified sequence opt2 from neuraminidase__InfluenzaA__ADD74741
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcuccuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109780 - RNA, 1410 nt, Artificial Sequence
  derived and/or modified sequence opt2 from neuraminidase__InfluenzaA__ADD74751
augaaccccaaccagaagaucaucaccaucggcuccgucugcaugaccaucggcauggccaaccucauccuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucaaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaugaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109781 - RNA, 1410 nt, Artificial Sequence
  derived and/or modified sequence opt2 from neuraminidase__InfluenzaA__ADD74761
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcaucaacuccgacaccgucggcugguccuggcccgacggcgccgagcuccccuucaccaucgacaaguga

SEQ ID NO: 109782 - RNA, 1410 nt, Artificial Sequence; identical to SEQ ID NO: 108250
  derived and/or modified sequence opt2 from neuraminidase__InfluenzaA__ADD74791

SEQ ID NO: 109783 - RNA, 1410 nt, Artificial Sequence; identical to SEQ ID NO: 108833
  derived and/or modified sequence opt2 from neuraminidase__InfluenzaA__ADD74811

SEQ ID NO: 109784 - RNA, 1410 nt, Artificial Sequence; identical to SEQ ID NO: 108250
  derived and/or modified sequence opt2 from neuraminidase__InfluenzaA__ADD74821

SEQ ID NO: 109785 - RNA, 1410 nt, Artificial Sequence
  derived and/or modified sequence opt2 from neuraminidase__InfluenzaA__ADD74831
augaaccccaaccagaagaucaucaccaucggcuccaucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugccucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109786 - RNA, 1410 nt, Artificial Sequence; identical to SEQ ID NO: 108250
  derived and/or modified sequence opt2 from neuraminidase__InfluenzaA__ADD74841

SEQ ID NO: 109787 - RNA, 1410 nt, Artificial Sequence; identical to SEQ ID NO: 108250
  derived and/or modified sequence opt2 from neuraminidase__InfluenzaA__ADD74851

SEQ ID NO: 109788 - RNA, 1410 nt, Artificial Sequence; identical to SEQ ID NO: 109357
  derived and/or modified sequence opt2 from neuraminidase__InfluenzaA__ADD74861

SEQ ID NO: 109789 - RNA, 1410 nt, Artificial Sequence; identical to SEQ ID NO: 108250
  derived and/or modified sequence opt2 from neuraminidase__InfluenzaA__ADD74871

SEQ ID NO: 109790 - RNA, 1410 nt, Artificial Sequence; identical to SEQ ID NO: 108250
  derived and/or modified sequence opt2 from neuraminidase__InfluenzaA__ADD74881

SEQ ID NO: 109791 - RNA, 1410 nt, Artificial Sequence; identical to SEQ ID NO: 108250
  derived and/or modified sequence opt2 from neuraminidase__InfluenzaA__ADD74891

SEQ ID NO: 109792 - RNA, 1410 nt, Artificial Sequence; identical to SEQ ID NO: 108250
  derived and/or modified sequence opt2 from neuraminidase__InfluenzaA__ADD74901

SEQ ID NO: 109793 - RNA, 1410 nt, Artificial Sequence; identical to SEQ ID NO: 108250
  derived and/or modified sequence opt2 from neuraminidase__InfluenzaA__ADD74911

SEQ ID NO: 109794 - RNA, 1410 nt, Artificial Sequence; identical to SEQ ID NO: 108250
  derived and/or modified sequence opt2 from neuraminidase__InfluenzaA__ADD74921

SEQ ID NO: 109795 - RNA, 1410 nt, Artificial Sequence; identical to SEQ ID NO: 108250
  derived and/or modified sequence opt2 from neuraminidase__InfluenzaA__ADD74941

SEQ ID NO: 109796 - RNA, 1410 nt, Artificial Sequence
  derived and/or modified sequence opt2 from neuraminidase__InfluenzaA__ADD74961
augaaccccaaccagaagaucaucaccaucggcuccgucugcaugaccaucggcauggccaaccucauccuccagaucggcaacaucaucuccaucuggaucucccacuccauccagcucggcaaccagaaccagaucggcaccugcaaccaguccgucaucaccuacgagaacaacaccugggucaaccacaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109797 - RNA, 1410 nt, Artificial Sequence; identical to SEQ ID NO: 108250
  derived and/or modified sequence opt2 from neuraminidase__InfluenzaA__ADD74971

SEQ ID NO: 109798 - RNA, 1410 nt, Artificial Sequence
  derived and/or modified sequence opt2 from neuraminidase__InfluenzaA__ADD74981
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 109799 - RNA, 1410 nt, Artificial Sequence; identical to SEQ ID NO: 108250
  derived and/or modified sequence opt2 from neuraminidase__InfluenzaA__ADD74991

SEQ ID NO: 109800 - RNA, 1410 nt, Artificial Sequence; identical to SEQ ID NO: 108250
  derived and/or modified sequence opt2 from neuraminidase__InfluenzaA__ADD75001

SEQ ID NO: 109801 - RNA, 1410 nt, Artificial Sequence
  derived and/or modified sequence opt2 from neuraminidase__InfluenzaA__ADD75011
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcgaccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109802 - RNA, 1410 nt, Artificial Sequence; identical to SEQ ID NO: 109538
  derived and/or modified sequence opt2 from neuraminidase__InfluenzaA__ADD75031

SEQ ID NO: 109803 - RNA, 1410 nt, Artificial Sequence
  derived and/or modified sequence opt2 from neuraminidase__InfluenzaA__ADD75041
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaagaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109804 - RNA, 1410 nt, Artificial Sequence; identical to SEQ ID NO: 108250
  derived and/or modified sequence opt2 from neuraminidase__InfluenzaA__ADD75051

SEQ ID NO: 109805 - RNA, 1410 nt, Artificial Sequence; identical to SEQ ID NO: 108250
  derived and/or modified sequence opt2 from neuraminidase__InfluenzaA__ADD75061

SEQ ID NO: 109806 - RNA, 1410 nt, Artificial Sequence; identical to SEQ ID NO: 108250
  derived and/or modified sequence opt2 from neuraminidase__InfluenzaA__ADD75071

SEQ ID NO: 109807 - RNA, 1410 nt, Artificial Sequence; identical to SEQ ID NO: 108250
  derived and/or modified sequence opt2 from neuraminidase__InfluenzaA__ADD75081

SEQ ID NO: 109808 - RNA, 1410 nt, Artificial Sequence
  derived and/or modified sequence opt2 from neuraminidase__InfluenzaA__ADD75091
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109809 - RNA, 1410 nt, Artificial Sequence; identical to SEQ ID NO: 108250
  derived and/or modified sequence opt2 from neuraminidase__InfluenzaA__ADD75101

SEQ ID NO: 109810 - RNA, 1410 nt, Artificial Sequence; identical to SEQ ID NO: 108250
  derived and/or modified sequence opt2 from neuraminidase__InfluenzaA__ADD75111

SEQ ID NO: 109811 - RNA, 1410 nt, Artificial Sequence; identical to SEQ ID NO: 108250
  derived and/or modified sequence opt2 from neuraminidase__InfluenzaA__ADD75121

SEQ ID NO: 109812 - RNA, 1410 nt, Artificial Sequence; identical to SEQ ID NO: 108250
  derived and/or modified sequence opt2 from neuraminidase__InfluenzaA__ADD75131

SEQ ID NO: 109813 - RNA, 1410 nt, Artificial Sequence; identical to SEQ ID NO: 108250
  derived and/or modified sequence opt2 from neuraminidase__InfluenzaA__ADD75141

SEQ ID NO: 109814 - RNA, 1410 nt, Artificial Sequence
  derived and/or modified sequence opt2 from neuraminidase__InfluenzaA__ADD75161
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccuccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguacaagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgaccgcuga

SEQ ID NO: 109815 - RNA, 1410 nt, Artificial Sequence
  derived and/or modified sequence opt2 from neuraminidase__InfluenzaA__ADD84500
augaaccccaaccagaacaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaucgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109816 - RNA, 1410 nt, Artificial Sequence
  derived and/or modified sequence opt2 from neuraminidase__InfluenzaA__ADD84502
augaaccccaaccagaacaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109817 - RNA, 1410 nt, Artificial Sequence; identical to SEQ ID NO: 109816
  derived and/or modified sequence opt2 from neuraminidase__InfluenzaA__ADD84503

SEQ ID NO: 109818 - RNA, 1410 nt, Artificial Sequence
  derived and/or modified sequence opt2 from neuraminidase__InfluenzaA__ADD84504
augaaccccaaccagaacaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuucucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109819 - RNA, 1410 nt, Artificial Sequence; identical to SEQ ID NO: 109816
  derived and/or modified sequence opt2 from neuraminidase__InfluenzaA__ADD84505

SEQ ID NO: 109820 - RNA, 1410 nt, Artificial Sequence; identical to SEQ ID NO: 109816
  derived and/or modified sequence opt2 from neuraminidase__InfluenzaA__ADD84506

SEQ ID NO: 109821 - RNA, 1410 nt, Artificial Sequence
  derived and/or modified sequence opt2 from neuraminidase__InfluenzaA__ADD92528
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggccacuccggcuccuccguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109822 - RNA, 1410 nt, Artificial Sequence; identical to SEQ ID NO: 109473
  derived and/or modified sequence opt2 from neuraminidase__InfluenzaA__ADD96769

SEQ ID NO: 109823 - RNA, 1410 nt, Artificial Sequence; identical to SEQ ID NO: 109473
  derived and/or modified sequence opt2 from neuraminidase__InfluenzaA__ADD96779

SEQ ID NO: 109824 - RNA, 1410 nt, Artificial Sequence; identical to SEQ ID NO: 109473
  derived and/or modified sequence opt2 from neuraminidase__InfluenzaA__ADD96789

SEQ ID NO: 109825 - RNA, 1410 nt, Artificial Sequence; identical to SEQ ID NO: 109601
  derived and/or modified sequence opt2 from neuraminidase__InfluenzaA__ADD96799

SEQ ID NO: 109826 - RNA, 1410 nt, Artificial Sequence; identical to SEQ ID NO: 108250
  derived and/or modified sequence opt2 from neuraminidase__InfluenzaA__ADD96809

SEQ ID NO: 109827 - RNA, 1410 nt, Artificial Sequence
  derived and/or modified sequence opt2 from neuraminidase__InfluenzaA__ADD96819
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcuccuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109828 - RNA, 1410 nt, Artificial Sequence; identical to SEQ ID NO: 108250
  derived and/or modified sequence opt2 from neuraminidase__InfluenzaA__ADD96829

SEQ ID NO: 109829 - RNA, 1410 nt, Artificial Sequence; identical to SEQ ID NO: 108250
  derived and/or modified sequence opt2 from neuraminidase__InfluenzaA__ADD96839

SEQ ID NO: 109830 - RNA, 1410 nt, Artificial Sequence; identical to SEQ ID NO: 108250
  derived and/or modified sequence opt2 from neuraminidase__InfluenzaA__ADD96849

SEQ ID NO: 109831 - RNA, 1410 nt, Artificial Sequence; identical to SEQ ID NO: 108250
  derived and/or modified sequence opt2 from neuraminidase__InfluenzaA__ADD96859

SEQ ID NO: 109832 - RNA, 1410 nt, Artificial Sequence
  derived and/or modified sequence opt2 from neuraminidase__InfluenzaA__ADD96869
augaaccccaaccagaagaucaucaccaucggcuccgucugcaugaccaucggcauggccaaccucauccuccagaucggcaacaucaucuccaucuggaucucccaccccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109833 - RNA, 1410 nt, Artificial Sequence
  derived and/or modified sequence opt2 from neuraminidase__InfluenzaA__ADD96879
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucggcugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109834 - RNA, 1410 nt, Artificial Sequence; identical to SEQ ID NO: 108250
  derived and/or modified sequence opt2 from neuraminidase__InfluenzaA__ADD96889

SEQ ID NO: 109835 - RNA, 1410 nt, Artificial Sequence; identical to SEQ ID NO: 108833
  derived and/or modified sequence opt2 from neuraminidase__InfluenzaA__ADD96899

SEQ ID NO: 109836 - RNA, 1410 nt, Artificial Sequence; identical to SEQ ID NO: 108250
  derived and/or modified sequence opt2 from neuraminidase__InfluenzaA__ADD96909

SEQ ID NO: 109837 - RNA, 1410 nt, Artificial Sequence; identical to SEQ ID NO: 108250
  derived and/or modified sequence opt2 from neuraminidase__InfluenzaA__ADD96919

SEQ ID NO: 109838 - RNA, 1410 nt, Artificial Sequence; identical to SEQ ID NO: 108250
  derived and/or modified sequence opt2 from neuraminidase__InfluenzaA__ADD96929

SEQ ID NO: 109839 - RNA, 1410 nt, Artificial Sequence; identical to SEQ ID NO: 108250
  derived and/or modified sequence opt2 from neuraminidase__InfluenzaA__ADD96939

SEQ ID NO: 109840 - RNA, 1410 nt, Artificial Sequence; identical to SEQ ID NO: 108250
  derived and/or modified sequence opt2 from neuraminidase__InfluenzaA__ADD96959

SEQ ID NO: 109841 - RNA, 1410 nt, Artificial Sequence; identical to SEQ ID NO: 108250
  derived and/or modified sequence opt2 from neuraminidase__InfluenzaA__ADD96969

SEQ ID NO: 109842 - RNA, 1410 nt, Artificial Sequence
  derived and/or modified sequence opt2 from neuraminidase__InfluenzaA__ADD96989
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccuccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109843 - RNA, 1410 nt, Artificial Sequence
  derived and/or modified sequence opt2 from neuraminidase__InfluenzaA__ADD97038
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaucggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccggcggcugguccuggcccgacggcgccgagcuccccuucaccaucgacaaguga

SEQ ID NO: 109844 - RNA, 1410 nt, Artificial Sequence; identical to SEQ ID NO: 108250
  derived and/or modified sequence opt2 from neuraminidase__InfluenzaA__ADD97048

SEQ ID NO: 109845 - RNA, 1410 nt, Artificial Sequence; identical to SEQ ID NO: 108250
  derived and/or modified sequence opt2 from neuraminidase__InfluenzaA__ADD97058

SEQ ID NO: 109846 - RNA, 1410 nt, Artificial Sequence; identical to SEQ ID NO: 108250
  derived and/or modified sequence opt2 from neuraminidase__InfluenzaA__ADD97069

SEQ ID NO: 109847 - RNA, 1410 nt, Artificial Sequence; identical to SEQ ID NO: 108250
  derived and/or modified sequence opt2 from neuraminidase__InfluenzaA__ADD97126

SEQ ID NO: 109848 - RNA, 1410 nt, Artificial Sequence; identical to SEQ ID NO: 108250
  derived and/or modified sequence opt2 from neuraminidase__InfluenzaA__ADD97164

SEQ ID NO: 109849 - RNA, 1410 nt, Artificial Sequence; identical to SEQ ID NO: 108250
  derived and/or modified sequence opt2 from neuraminidase__InfluenzaA__ADD97174

SEQ ID NO: 109850 - RNA, 1410 nt, Artificial Sequence; identical to SEQ ID NO: 108250
  derived and/or modified sequence opt2 from neuraminidase__InfluenzaA__ADD97184

SEQ ID NO: 109851 - RNA, 1410 nt, Artificial Sequence
  derived and/or modified sequence opt2 from neuraminidase__InfluenzaA__ADD97194
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacgccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109852 - RNA, 1410 nt, Artificial Sequence; identical to SEQ ID NO: 109842
  derived and/or modified sequence opt2 from neuraminidase__InfluenzaA__ADD97204

SEQ ID NO: 109853 - RNA, 1410 nt, Artificial Sequence; identical to SEQ ID NO: 108250
  derived and/or modified sequence opt2 from neuraminidase__InfluenzaA__ADD97214

SEQ ID NO: 109854 - RNA, 1410 nt, Artificial Sequence; identical to SEQ ID NO: 108250
  derived and/or modified sequence opt2 from neuraminidase__InfluenzaA__ADD97224

SEQ ID NO: 109855 - RNA, 1410 nt, Artificial Sequence; identical to SEQ ID NO: 108250
  derived and/or modified sequence opt2 from neuraminidase__InfluenzaA__ADD97234

SEQ ID NO: 109856 - RNA, 1410 nt, Artificial Sequence; identical to SEQ ID NO: 108250
  derived and/or modified sequence opt2 from neuraminidase__InfluenzaA__ADD97244

SEQ ID NO: 109857 - RNA, 1410 nt, Artificial Sequence; identical to SEQ ID NO: 108250
  derived and/or modified sequence opt2 from neuraminidase__InfluenzaA__ADD97254

SEQ ID NO: 109858 - RNA, 1410 nt, Artificial Sequence; identical to SEQ ID NO: 108250
  derived and/or modified sequence opt2 from neuraminidase__InfluenzaA__ADD97264

SEQ ID NO: 109859 - RNA, 1410 nt, Artificial Sequence; identical to SEQ ID NO: 108250
  derived and/or modified sequence opt2 from neuraminidase__InfluenzaA__ADD97274

SEQ ID NO: 109860 - RNA, 1410 nt, Artificial Sequence
  derived and/or modified sequence opt2 from neuraminidase__InfluenzaA__ADD97284
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucugcaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109861 - RNA, 1410 nt, Artificial Sequence; identical to SEQ ID NO: 108250
  derived and/or modified sequence opt2 from neuraminidase__InfluenzaA__ADD97294

SEQ ID NO: 109862 - RNA, 1410 nt, Artificial Sequence
  derived and/or modified sequence opt2 from neuraminidase__InfluenzaA__ADD97314
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109863 - RNA, 1410 nt, Artificial Sequence; identical to SEQ ID NO: 108250
  derived and/or modified sequence opt2 from neuraminidase__InfluenzaA__ADD97334

SEQ ID NO: 109864 - RNA, 1410 nt, Artificial Sequence; identical to SEQ ID NO: 108250
  derived and/or modified sequence opt2 from neuraminidase__InfluenzaA__ADD97344

SEQ ID NO: 109865 - RNA, 1410 nt, Artificial Sequence; identical to SEQ ID NO: 108250
  derived and/or modified sequence opt2 from neuraminidase__InfluenzaA__ADD97354

SEQ ID NO: 109866 - RNA, 1410 nt, Artificial Sequence
  derived and/or modified sequence opt2 from neuraminidase__InfluenzaA__ADD97384
augaaccccaaccagaagaucaucaccaucggcuccgucugcaugaccaucggcauggccaaccucauccuccagaucggcaacaucaucuccaucuggaucucccacaccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109867 - RNA, 1410 nt, Artificial Sequence
  derived and/or modified sequence opt2 from neuraminidase__InfluenzaA__ADD97394
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109868 - RNA, 1410 nt, Artificial Sequence; identical to SEQ ID NO: 108250
  derived and/or modified sequence opt2 from neuraminidase__InfluenzaA__ADD97404

SEQ ID NO: 109869 - RNA, 1410 nt, Artificial Sequence; identical to SEQ ID NO: 108250
  derived and/or modified sequence opt2 from neuraminidase__InfluenzaA__ADD97424

SEQ ID NO: 109870 - RNA, 1410 nt, Artificial Sequence; identical to SEQ ID NO: 108250
  derived and/or modified sequence opt2 from neuraminidase__InfluenzaA__ADD97434

SEQ ID NO: 109871 - RNA, 1410 nt, Artificial Sequence; identical to SEQ ID NO: 108250
  derived and/or modified sequence opt2 from neuraminidase__InfluenzaA__ADD97444

SEQ ID NO: 109872 - RNA, 1410 nt, Artificial Sequence
  derived and/or modified sequence opt2 from neuraminidase__InfluenzaA__ADD97454
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccaucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucuccgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109873 - RNA, 1410 nt, Artificial Sequence
  derived and/or modified sequence opt2 from neuraminidase__InfluenzaA__ADD97464
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaccaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109874 - RNA, 1410 nt, Artificial Sequence; identical to SEQ ID NO: 108250
  derived and/or modified sequence opt2 from neuraminidase__InfluenzaA__ADD97474

SEQ ID NO: 109875 - RNA, 1410 nt, Artificial Sequence; identical to SEQ ID NO: 108250
  derived and/or modified sequence opt2 from neuraminidase__InfluenzaA__ADD97484

SEQ ID NO: 109876 - RNA, 1410 nt, Artificial Sequence
  derived and/or modified sequence opt2 from neuraminidase__InfluenzaA__ADD97494
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109877 - RNA, 1410 nt, Artificial Sequence; identical to SEQ ID NO: 108250
  derived and/or modified sequence opt2 from neuraminidase__InfluenzaA__ADD97504

SEQ ID NO: 109878 - RNA, 1410 nt, Artificial Sequence; identical to SEQ ID NO: 108250
  derived and/or modified sequence opt2 from neuraminidase__InfluenzaA__ADD97514

SEQ ID NO: 109879 - RNA, 1410 nt, Artificial Sequence; identical to SEQ ID NO: 109862
  derived and/or modified sequence opt2 from neuraminidase__InfluenzaA__ADD97534

SEQ ID NO: 109880 - RNA, 1410 nt, Artificial Sequence; identical to SEQ ID NO: 108250
  derived and/or modified sequence opt2 from neuraminidase__InfluenzaA__ADD97544

SEQ ID NO: 109881 - RNA, 1410 nt, Artificial Sequence; identical to SEQ ID NO: 108250
  derived and/or modified sequence opt2 from neuraminidase__InfluenzaA__ADD97554

SEQ ID NO: 109882 - RNA, 1410 nt, Artificial Sequence; identical to SEQ ID NO: 109866
  derived and/or modified sequence opt2 from neuraminidase__InfluenzaA__ADD97564

SEQ ID NO: 109883 - RNA, 1410 nt, Artificial Sequence; identical to SEQ ID NO: 108250
  derived and/or modified sequence opt2 from neuraminidase__InfluenzaA__ADD97574

SEQ ID NO: 109884 - RNA, 1410 nt, Artificial Sequence; identical to SEQ ID NO: 108250
  derived and/or modified sequence opt2 from neuraminidase__InfluenzaA__ADD97584

SEQ ID NO: 109885 - RNA, 1410 nt, Artificial Sequence
  derived and/or modified sequence opt2 from neuraminidase__InfluenzaA__ADD97681
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcaucaacuccgacaccgucggcugguccuggcccgacggcgccgagcuccccuucaccaucgacaaguga

SEQ ID NO: 109886 - RNA, 1410 nt, Artificial Sequence; identical to SEQ ID NO: 109842
  derived and/or modified sequence opt2 from neuraminidase__InfluenzaA__ADD97691

SEQ ID NO: 109887 - RNA, 1410 nt, Artificial Sequence; identical to SEQ ID NO: 109387
  derived and/or modified sequence opt2 from neuraminidase__InfluenzaA__ADD97701

SEQ ID NO: 109888 - RNA, 1410 nt, Artificial Sequence; identical to SEQ ID NO: 108250
  derived and/or modified sequence opt2 from neuraminidase__InfluenzaA__ADD97891

SEQ ID NO: 109889 - RNA, 1410 nt, Artificial Sequence; identical to SEQ ID NO: 108250
  derived and/or modified sequence opt2 from neuraminidase__InfluenzaA__ADD97901

SEQ ID NO: 109890 - RNA, 1410 nt, Artificial Sequence; identical to SEQ ID NO: 108250
  derived and/or modified sequence opt2 from neuraminidase__InfluenzaA__ADD97911

SEQ ID NO: 109891 - RNA, 1410 nt, Artificial Sequence; identical to SEQ ID NO: 108250
  derived and/or modified sequence opt2 from neuraminidase__InfluenzaA__ADD97921

SEQ ID NO: 109892 - RNA, 1410 nt, Artificial Sequence; identical to SEQ ID NO: 108250
  derived and/or modified sequence opt2 from neuraminidase__InfluenzaA__ADD97931

SEQ ID NO: 109893 - RNA, 1410 nt, Artificial Sequence; identical to SEQ ID NO: 109017
  derived and/or modified sequence opt2 from neuraminidase__InfluenzaA__ADD97941

SEQ ID NO: 109894 - RNA, 1410 nt, Artificial Sequence
  derived and/or modified sequence opt2 from neuraminidase__InfluenzaA__ADD97951
augaaccccaaccagaagaucaucaccaucuccuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109895 - RNA, 1410 nt, Artificial Sequence
  derived and/or modified sequence opt2 from neuraminidase__InfluenzaA__ADD97961
augaaccccaaccagaagaucaucaccaucggcuccgucugcaugaccaucggcauggucaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacgccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109896 - RNA, 1410 nt, Artificial Sequence; identical to SEQ ID NO: 109842
  derived and/or modified sequence opt2 from neuraminidase__InfluenzaA__ADD97971

SEQ ID NO: 109897 - RNA, 1410 nt, Artificial Sequence; identical to SEQ ID NO: 108250
  derived and/or modified sequence opt2 from neuraminidase__InfluenzaA__ADD97981

SEQ ID NO: 109898 - RNA, 1410 nt, Artificial Sequence
  derived and/or modified sequence opt2 from neuraminidase__InfluenzaA__ADD97991
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaucggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109899 - RNA, 1410 nt, Artificial Sequence
  derived and/or modified sequence opt2 from neuraminidase__InfluenzaA__ADD98001
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccgucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109900 - RNA, 1410 nt, Artificial Sequence; identical to SEQ ID NO: 108250
  derived and/or modified sequence opt2 from neuraminidase__InfluenzaA__ADD98011

SEQ ID NO: 109901 - RNA, 1410 nt, Artificial Sequence; identical to SEQ ID NO: 108250
  derived and/or modified sequence opt2 from neuraminidase__InfluenzaA__ADD98031

SEQ ID NO: 109902 - RNA, 1410 nt, Artificial Sequence; identical to SEQ ID NO: 109899
  derived and/or modified sequence opt2 from neuraminidase__InfluenzaA__ADD98041

SEQ ID NO: 109903 - RNA, 1410 nt, Artificial Sequence; identical to SEQ ID NO: 108250
  derived and/or modified sequence opt2 from neuraminidase__InfluenzaA__ADD98051

SEQ ID NO: 109904 - RNA, 1410 nt, Artificial Sequence; identical to SEQ ID NO: 108250
  derived and/or modified sequence opt2 from neuraminidase__InfluenzaA__ADD98061

SEQ ID NO: 109905 - RNA, 1410 nt, Artificial Sequence; identical to SEQ ID NO: 108250
  derived and/or modified sequence opt2 from neuraminidase__InfluenzaA__ADD98071

SEQ ID NO: 109906 - RNA, 1410 nt, Artificial Sequence; identical to SEQ ID NO: 108250
  derived and/or modified sequence opt2 from neuraminidase__InfluenzaA__ADD98081

SEQ ID NO: 109907 - RNA, 1410 nt, Artificial Sequence; identical to SEQ ID NO: 108250
  derived and/or modified sequence opt2 from neuraminidase__InfluenzaA__ADD98091

SEQ ID NO: 109908 - RNA, 1410 nt, Artificial Sequence; identical to SEQ ID NO: 109076
  derived and/or modified sequence opt2 from neuraminidase__InfluenzaA__ADD98101

SEQ ID NO: 109909 - RNA, 1410 nt, Artificial Sequence
  derived and/or modified sequence opt2 from neuraminidase__InfluenzaA__ADD98111
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcauccucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109910 - RNA, 1410 nt, Artificial Sequence; identical to SEQ ID NO: 108250
  derived and/or modified sequence opt2 from neuraminidase__InfluenzaA__ADD98121

SEQ ID NO: 109911 - RNA, 1410 nt, Artificial Sequence; identical to SEQ ID NO: 108250
  derived and/or modified sequence opt2 from neuraminidase__InfluenzaA__ADD98131

SEQ ID NO: 109912 - RNA, 1410 nt, Artificial Sequence; identical to SEQ ID NO: 108250
  derived and/or modified sequence opt2 from neuraminidase__InfluenzaA__ADD98141

SEQ ID NO: 109913 - RNA, 1410 nt, Artificial Sequence; identical to SEQ ID NO: 108250
  derived and/or modified sequence opt2 from neuraminidase__InfluenzaA__ADD98151

SEQ ID NO: 109914 - RNA, 1410 nt, Artificial Sequence
  derived and/or modified sequence opt2 from neuraminidase__InfluenzaA__ADD98161
augaaccccaaccagaagaucaucaccaucggcuccgucugcaugaccaucggcauggccaaccucauccuccagaucggcaacaucaucuccaucuggaucucccacaccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggacccgcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109915 - RNA, 1410 nt, Artificial Sequence
  derived and/or modified sequence opt2 from neuraminidase__InfluenzaA__ADD98171
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccagaccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgcuccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109916 - RNA, 1410 nt, Artificial Sequence
  derived and/or modified sequence opt2 from neuraminidase__InfluenzaA__ADD98181
augaaccccaaccagaagaucaucaccaucggcuccgucugcaugaccaucggcauggccaaccucauccuccagaucggcaacaugaucuccaucuggaucucccacuccauccagcucgagaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109917 - RNA, 1410 nt, Artificial Sequence; identical to SEQ ID NO: 108250
  derived and/or modified sequence opt2 from neuraminidase__InfluenzaA__ADD98201

SEQ ID NO: 109918 - RNA, 1410 nt, Artificial Sequence; identical to SEQ ID NO: 108250
  derived and/or modified sequence opt2 from neuraminidase__InfluenzaA__ADD98211

SEQ ID NO: 109919 - RNA, 1410 nt, Artificial Sequence; identical to SEQ ID NO: 109473
  derived and/or modified sequence opt2 from neuraminidase__InfluenzaA__ADE20324

SEQ ID NO: 109920 - RNA, 1410 nt, Artificial Sequence; identical to SEQ ID NO: 109473
  derived and/or modified sequence opt2 from neuraminidase__InfluenzaA__ADE20334

SEQ ID NO: 109921 - RNA, 1410 nt, Artificial Sequence; identical to SEQ ID NO: 109473
  derived and/or modified sequence opt2 from neuraminidase__InfluenzaA__ADE20344

SEQ ID NO: 109922 - RNA, 1410 nt, Artificial Sequence; identical to SEQ ID NO: 109473
  derived and/or modified sequence opt2 from neuraminidase__InfluenzaA__ADE20354

SEQ ID NO: 109923 - RNA, 1410 nt, Artificial Sequence; identical to SEQ ID NO: 109473
  derived and/or modified sequence opt2 from neuraminidase__InfluenzaA__ADE20378

SEQ ID NO: 109924 - RNA, 1410 nt, Artificial Sequence; identical to SEQ ID NO: 109473
  derived and/or modified sequence opt2 from neuraminidase__InfluenzaA__ADE20391

SEQ ID NO: 109925 - RNA, 1410 nt, Artificial Sequence; identical to SEQ ID NO: 109473
  derived and/or modified sequence opt2 from neuraminidase__InfluenzaA__ADE20631

SEQ ID NO: 109926 - RNA, 1410 nt, Artificial Sequence; identical to SEQ ID NO: 109473
  derived and/or modified sequence opt2 from neuraminidase__InfluenzaA__ADE20641

SEQ ID NO: 109927 - RNA, 1410 nt, Artificial Sequence
  derived and/or modified sequence opt2 from neuraminidase__InfluenzaA__ADE20651
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109928 - RNA, 1410 nt, Artificial Sequence; identical to SEQ ID NO: 109473
  derived and/or modified sequence opt2 from neuraminidase__InfluenzaA__ADE20661

SEQ ID NO: 109929 - RNA, 1410 nt, Artificial Sequence; identical to SEQ ID NO: 109473
  derived and/or modified sequence opt2 from neuraminidase__InfluenzaA__ADE20671

SEQ ID NO: 109930 - RNA, 1410 nt, Artificial Sequence; identical to SEQ ID NO: 109473
  derived and/or modified sequence opt2 from neuraminidase__InfluenzaA__ADE20681

SEQ ID NO: 109931 - RNA, 1410 nt, Artificial Sequence
  derived and/or modified sequence opt2 from neuraminidase__InfluenzaA__ADE20701
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcgucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109932 - RNA, 1410 nt, Artificial Sequence; identical to SEQ ID NO: 109473
  derived and/or modified sequence opt2 from neuraminidase__InfluenzaA__ADE20711

SEQ ID NO: 109933 - RNA, 1410 nt, Artificial Sequence
  derived and/or modified sequence opt2 from neuraminidase__InfluenzaA__ADE20721
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgaccgcuga

SEQ ID NO: 109934 - RNA, 1410 nt, Artificial Sequence; identical to SEQ ID NO: 109931
  derived and/or modified sequence opt2 from neuraminidase__InfluenzaA__ADE20731

SEQ ID NO: 109935 - RNA, 1410 nt, Artificial Sequence; identical to SEQ ID NO: 109473
  derived and/or modified sequence opt2 from neuraminidase__InfluenzaA__ADE20741

SEQ ID NO: 109936 - RNA, 1410 nt, Artificial Sequence; identical to SEQ ID NO: 109473
  derived and/or modified sequence opt2 from neuraminidase__InfluenzaA__ADE20751

SEQ ID NO: 109937 - RNA, 1410 nt, Artificial Sequence; identical to SEQ ID NO: 109931
  derived and/or modified sequence opt2 from neuraminidase__InfluenzaA__ADE20761

SEQ ID NO: 109938 - RNA, 1410 nt, Artificial Sequence; identical to SEQ ID NO: 109931
  derived and/or modified sequence opt2 from neuraminidase__InfluenzaA__ADE20781

SEQ ID NO: 109939 - RNA, 1410 nt, Artificial Sequence; identical to SEQ ID NO: 108250
  derived and/or modified sequence opt2 from neuraminidase__InfluenzaA__ADE20791

SEQ ID NO: 109940 - RNA, 1410 nt, Artificial Sequence; identical to SEQ ID NO: 108250
  derived and/or modified sequence opt2 from neuraminidase__InfluenzaA__ADE20801

SEQ ID NO: 109941 - RNA, 1410 nt, Artificial Sequence; identical to SEQ ID NO: 108250
  derived and/or modified sequence opt2 from neuraminidase__InfluenzaA__ADE20811

SEQ ID NO: 109942 - RNA, 1410 nt, Artificial Sequence; identical to SEQ ID NO: 108250
  derived and/or modified sequence opt2 from neuraminidase__InfluenzaA__ADE20821

SEQ ID NO: 109943 - RNA, 1410 nt, Artificial Sequence; identical to SEQ ID NO: 108250
  derived and/or modified sequence opt2 from neuraminidase__InfluenzaA__ADE20831

SEQ ID NO: 109944 - RNA, 1410 nt, Artificial Sequence; identical to SEQ ID NO: 108250
  derived and/or modified sequence opt2 from neuraminidase__InfluenzaA__ADE20841

SEQ ID NO: 109945 - RNA, 1410 nt, Artificial Sequence; identical to SEQ ID NO: 108250
  derived and/or modified sequence opt2 from neuraminidase__InfluenzaA__ADE20851

SEQ ID NO: 109946 - RNA, 1410 nt, Artificial Sequence; identical to SEQ ID NO: 109866
  derived and/or modified sequence opt2 from neuraminidase__InfluenzaA__ADE20861

SEQ ID NO: 109947 - RNA, 1410 nt, Artificial Sequence; identical to SEQ ID NO: 108250
  derived and/or modified sequence opt2 from neuraminidase__InfluenzaA__ADE20871

SEQ ID NO: 109948 - RNA, 1410 nt, Artificial Sequence; identical to SEQ ID NO: 109862
  derived and/or modified sequence opt2 from neuraminidase__InfluenzaA__ADE20881

SEQ ID NO: 109949 - RNA, 1410 nt, Artificial Sequence; identical to SEQ ID NO: 108250
  derived and/or modified sequence opt2 from neuraminidase__InfluenzaA__ADE20891

SEQ ID NO: 109950 - RNA, 1410 nt, Artificial Sequence; identical to SEQ ID NO: 108250
  derived and/or modified sequence opt2 from neuraminidase__InfluenzaA__ADE20901

SEQ ID NO: 109951 - RNA, 1410 nt, Artificial Sequence; identical to SEQ ID NO: 108250
  derived and/or modified sequence opt2 from neuraminidase__InfluenzaA__ADE20911

SEQ ID NO: 109952 - RNA, 1410 nt, Artificial Sequence; identical to SEQ ID NO: 108250
  derived and/or modified sequence opt2 from neuraminidase__InfluenzaA__ADE20921

SEQ ID NO: 109953 - RNA, 1410 nt, Artificial Sequence
  derived and/or modified sequence opt2 from neuraminidase__InfluenzaA__ADE20931
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccucuccaacggcgccaacggcgucaagggcuucuccuucaaguacggcaacggcgucuggaucggccgcaccaaguccaucggcucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109954 - RNA, 1410 nt, Artificial Sequence; identical to SEQ ID NO: 108250
  derived and/or modified sequence opt2 from neuraminidase__InfluenzaA__ADE20941

SEQ ID NO: 109955 - RNA, 1410 nt, Artificial Sequence
  derived and/or modified sequence opt2 from neuraminidase__InfluenzaA__ADE20951
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacgucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109956 - RNA, 1410 nt, Artificial Sequence
  derived and/or modified sequence opt2 from neuraminidase__InfluenzaA__ADE20961
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacgacaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109957 - RNA, 1410 nt, Artificial Sequence; identical to SEQ ID NO: 108250
  derived and/or modified sequence opt2 from neuraminidase__InfluenzaA__ADE20971

SEQ ID NO: 109958 - RNA, 1410 nt, Artificial Sequence; identical to SEQ ID NO: 109866
  derived and/or modified sequence opt2 from neuraminidase__InfluenzaA__ADE20981

SEQ ID NO: 109959 - RNA, 1410 nt, Artificial Sequence; identical to SEQ ID NO: 108250
  derived and/or modified sequence opt2 from neuraminidase__InfluenzaA__ADE20991

SEQ ID NO: 109960 - RNA, 1410 nt, Artificial Sequence
  derived and/or modified sequence opt2 from neuraminidase__InfluenzaA__ADE21001
augaaccccaaccagaagaucaucaccaucggcuccgucugcaugaccaucggcauggccaaccucauccuccagaucggcaacaucaucuccaucuggaucucccacaccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucaucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109961 - RNA, 1410 nt, Artificial Sequence; identical to SEQ ID NO: 108250
  derived and/or modified sequence opt2 from neuraminidase__InfluenzaA__ADE21011

SEQ ID NO: 109962 - RNA, 1410 nt, Artificial Sequence; identical to SEQ ID NO: 108250
  derived and/or modified sequence opt2 from neuraminidase__InfluenzaA__ADE21021

SEQ ID NO: 109963 - RNA, 1410 nt, Artificial Sequence; identical to SEQ ID NO: 109899
  derived and/or modified sequence opt2 from neuraminidase__InfluenzaA__ADE21031

SEQ ID NO: 109964 - RNA, 1410 nt, Artificial Sequence
  derived and/or modified sequence opt2 from neuraminidase__InfluenzaA__ADE21041
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccaucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109965 - RNA, 1410 nt, Artificial Sequence; identical to SEQ ID NO: 108250
  derived and/or modified sequence opt2 from neuraminidase__InfluenzaA__ADE21051

SEQ ID NO: 109966 - RNA, 1410 nt, Artificial Sequence
  derived and/or modified sequence opt2 from neuraminidase__InfluenzaA__ADE21071
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109967 - RNA, 1413 nt, Artificial Sequence; identical to SEQ ID NO: 108144
  derived and/or modified sequence opt2 from neuraminidase__InfluenzaA__ADE28752

SEQ ID NO: 109968 - RNA, 1413 nt, Artificial Sequence; identical to SEQ ID NO: 108973
  derived and/or modified sequence opt2 from neuraminidase__InfluenzaA__ADE28763

SEQ ID NO: 109969 - RNA, 1410 nt, Artificial Sequence; identical to SEQ ID NO: 109473
  derived and/or modified sequence opt2 from neuraminidase__InfluenzaA__ADE28773

SEQ ID NO: 109970 - RNA, 1410 nt, Artificial Sequence; identical to SEQ ID NO: 109473
  derived and/or modified sequence opt2 from neuraminidase__InfluenzaA__ADE28783

SEQ ID NO: 109971 - RNA, 1410 nt, Artificial Sequence; identical to SEQ ID NO: 109931
  derived and/or modified sequence opt2 from neuraminidase__InfluenzaA__ADE28803

SEQ ID NO: 109972 - RNA, 1410 nt, Artificial Sequence; identical to SEQ ID NO: 108250
  derived and/or modified sequence opt2 from neuraminidase__InfluenzaA__ADE28813

SEQ ID NO: 109973 - RNA, 1410 nt, Artificial Sequence; identical to SEQ ID NO: 108250
  derived and/or modified sequence opt2 from neuraminidase__InfluenzaA__ADE28823

SEQ ID NO: 109974 - RNA, 1410 nt, Artificial Sequence
  derived and/or modified sequence opt2 from neuraminidase__InfluenzaA__ADE28843
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccgucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109975 - RNA, 1410 nt, Artificial Sequence
  derived and/or modified sequence opt2 from neuraminidase__InfluenzaA__ADE28853
augaaccccaaccagaagaucaucaccaucgucuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109976 - RNA, 1410 nt, Artificial Sequence; identical to SEQ ID NO: 109974
  derived and/or modified sequence opt2 from neuraminidase__InfluenzaA__ADE28884

SEQ ID NO: 109977 - RNA, 1410 nt, Artificial Sequence
  derived and/or modified sequence opt2 from neuraminidase__InfluenzaA__ADE28894
augaaccccaaccagaagaucaucaccaucggcuccgucugcaugaccaucggcauggccaaccucauccuccagaucggcaacaucaucuccaucuggaucucccacuccguccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109978 - RNA, 1410 nt, Artificial Sequence; identical to SEQ ID NO: 109898
  derived and/or modified sequence opt2 from neuraminidase__InfluenzaA__ADE28904

SEQ ID NO: 109979 - RNA, 1410 nt, Artificial Sequence; identical to SEQ ID NO: 108250
  derived and/or modified sequence opt2 from neuraminidase__InfluenzaA__ADE28914

SEQ ID NO: 109980 - RNA, 1410 nt, Artificial Sequence; identical to SEQ ID NO: 108250
  derived and/or modified sequence opt2 from neuraminidase__InfluenzaA__ADE28924

SEQ ID NO: 109981 - RNA, 1410 nt, Artificial Sequence
  derived and/or modified sequence opt2 from neuraminidase__InfluenzaA__ADE28934
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcaucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109982 - RNA, 1410 nt, Artificial Sequence; identical to SEQ ID NO: 108250
  derived and/or modified sequence opt2 from neuraminidase__InfluenzaA__ADE28954

SEQ ID NO: 109983 - RNA, 1410 nt, Artificial Sequence
  derived and/or modified sequence opt2 from neuraminidase__InfluenzaA__ADE28964
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaucaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109984 - RNA, 1410 nt, Artificial Sequence; identical to SEQ ID NO: 108250
  derived and/or modified sequence opt2 from neuraminidase__InfluenzaA__ADE28974

SEQ ID NO: 109985 - RNA, 1410 nt, Artificial Sequence
  derived and/or modified sequence opt2 from neuraminidase__InfluenzaA__ADE29004
augaaccccaaccagaagaucaucaccaucggcuccgucugcaugaccaucggccucgccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaagaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109986 - RNA, 1410 nt, Artificial Sequence; identical to SEQ ID NO: 108250
  derived and/or modified sequence opt2 from neuraminidase__InfluenzaA__ADE29014

SEQ ID NO: 109987 - RNA, 1410 nt, Artificial Sequence
  derived and/or modified sequence opt2 from neuraminidase__InfluenzaA__ADE29024
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaacggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109988 - RNA, 1410 nt, Artificial Sequence; identical to SEQ ID NO: 108250
  derived and/or modified sequence opt2 from neuraminidase__InfluenzaA__ADE29034

SEQ ID NO: 109989 - RNA, 1410 nt, Artificial Sequence; identical to SEQ ID NO: 108250
  derived and/or modified sequence opt2 from neuraminidase__InfluenzaA__ADE29044

SEQ ID NO: 109990 - RNA, 1410 nt, Artificial Sequence; identical to SEQ ID NO: 108250
  derived and/or modified sequence opt2 from neuraminidase__InfluenzaA__ADE29054

SEQ ID NO: 109991 - RNA, 1410 nt, Artificial Sequence; identical to SEQ ID NO: 109538
  derived and/or modified sequence opt2 from neuraminidase__InfluenzaA__ADE29064

SEQ ID NO: 109992 - RNA, 1410 nt, Artificial Sequence
  derived and/or modified sequence opt2 from neuraminidase__InfluenzaA__ADE29087
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugcaagaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 109993 - RNA, 1410 nt, Artificial Sequence; identical to SEQ ID NO: 108240
  derived and/or modified sequence opt2 from neuraminidase__InfluenzaA__ADE29097

SEQ ID NO: 109994 - RNA, 1410 nt, Artificial Sequence; identical to SEQ ID NO: 109117
  derived and/or modified sequence opt2 from neuraminidase__InfluenzaA__ADE34194

SEQ ID NO: 109995 - RNA, 1410 nt, Artificial Sequence; identical to SEQ ID NO: 108111
  derived and/or modified sequence opt2 from neuraminidase__InfluenzaA__ADE34205

SEQ ID NO: 109996 - RNA, 1410 nt, Artificial Sequence
  derived and/or modified sequence opt2 from neuraminidase__InfluenzaA__ADE34216
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 109997 - RNA, 1410 nt, Artificial Sequence; identical to SEQ ID NO: 109117
  derived and/or modified sequence opt2 from neuraminidase__InfluenzaA__ADE34227

SEQ ID NO: 109998 - RNA, 1410 nt, Artificial Sequence; identical to SEQ ID NO: 109117
  derived and/or modified sequence opt2 from neuraminidase__InfluenzaA__ADE34238

SEQ ID NO: 109999 - RNA, 1410 nt, Artificial Sequence
  derived and/or modified sequence opt2 from neuraminidase__InfluenzaA__ADE34260
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucauguccaucuga

SEQ ID NO: 110000 - RNA, 1410 nt, Artificial Sequence; identical to SEQ ID NO: 109117
  derived and/or modified sequence opt2 from neuraminidase__InfluenzaA__ADE34271

SEQ ID NO: 110001 - RNA, 1410 nt, Artificial Sequence; identical to SEQ ID NO: 108250
  derived and/or modified sequence opt2 from neuraminidase__InfluenzaA__ADE45502

SEQ ID NO: 110002 - RNA, 1410 nt, Artificial Sequence; identical to SEQ ID NO: 108250
  derived and/or modified sequence opt2 from neuraminidase__InfluenzaA__ADE45504

SEQ ID NO: 110003 - RNA, 1410 nt, Artificial Sequence; identical to SEQ ID NO: 108250
  derived and/or modified sequence opt2 from neuraminidase__InfluenzaA__ADE45506

SEQ ID NO: 110004 - RNA, 1410 nt, Artificial Sequence; identical to SEQ ID NO: 108250
  derived and/or modified sequence opt2 from neuraminidase__InfluenzaA__ADE45508

SEQ ID NO: 110005 - RNA, 1410 nt, Artificial Sequence; identical to SEQ ID NO: 108250
  derived and/or modified sequence opt2 from neuraminidase__InfluenzaA__ADE45510

SEQ ID NO: 110006 - RNA, 1410 nt, Artificial Sequence; identical to SEQ ID NO: 108250
  derived and/or modified sequence opt2 from neuraminidase__InfluenzaA__ADE45512

SEQ ID NO: 110007 - RNA, 1410 nt, Artificial Sequence
  derived and/or modified sequence opt2 from neuraminidase__InfluenzaA__ADE45514
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuuccaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110008 - RNA, 1410 nt, Artificial Sequence
  derived and/or modified sequence opt2 from neuraminidase__InfluenzaA__ADE45516
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucucccuccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110009 - RNA, 1410 nt, Artificial Sequence
  derived and/or modified sequence opt2 from neuraminidase__InfluenzaA__ADF10069
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcacccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110010 - RNA, 1410 nt, Artificial Sequence; identical to SEQ ID NO: 108250
  derived and/or modified sequence opt2 from neuraminidase__InfluenzaA__ADF10079

SEQ ID NO: 110011 - RNA, 1410 nt, Artificial Sequence; identical to SEQ ID NO: 108250
  derived and/or modified sequence opt2 from neuraminidase__InfluenzaA__ADF10089

SEQ ID NO: 110012 - RNA, 1410 nt, Artificial Sequence; identical to SEQ ID NO: 108250
  derived and/or modified sequence opt2 from neuraminidase__InfluenzaA__ADF10099

SEQ ID NO: 110013 - RNA, 1410 nt, Artificial Sequence
  derived and/or modified sequence opt2 from neuraminidase__InfluenzaA__ADF10109
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcaacugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110014 - RNA, 1410 nt, Artificial Sequence; identical to SEQ ID NO: 108250
  derived and/or modified sequence opt2 from neuraminidase__InfluenzaA__ADF10129

SEQ ID NO: 110015 - RNA, 1410 nt, Artificial Sequence; identical to SEQ ID NO: 109680
  derived and/or modified sequence opt2 from neuraminidase__InfluenzaA__ADF10146

SEQ ID NO: 110016 - RNA, 1410 nt, Artificial Sequence
  derived and/or modified sequence opt2 from neuraminidase__InfluenzaA__ADF10166
augaaccccaaccagaagaucaucaccaucggcuccgucugcaugaucaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110017 - RNA, 1410 nt, Artificial Sequence; identical to SEQ ID NO: 110016
  derived and/or modified sequence opt2 from neuraminidase__InfluenzaA__ADF10176

SEQ ID NO: 110018 - RNA, 1410 nt, Artificial Sequence; identical to SEQ ID NO: 110016
  derived and/or modified sequence opt2 from neuraminidase__InfluenzaA__ADF10192

SEQ ID NO: 110019 - RNA, 1410 nt, Artificial Sequence; identical to SEQ ID NO: 108250
  derived and/or modified sequence opt2 from neuraminidase__InfluenzaA__ADF10247

SEQ ID NO: 110020 - RNA, 1410 nt, Artificial Sequence; identical to SEQ ID NO: 110016
  derived and/or modified sequence opt2 from neuraminidase__InfluenzaA__ADF10290

SEQ ID NO: 110021 - RNA, 1410 nt, Artificial Sequence
  derived and/or modified sequence opt2 from neuraminidase__InfluenzaA__ADF10304
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccggccuccccuucaccaucgacaaguga

SEQ ID NO: 110022 - RNA, 1410 nt, Artificial Sequence; identical to SEQ ID NO: 108250
  derived and/or modified sequence opt2 from neuraminidase__InfluenzaA__ADF10340

SEQ ID NO: 110023 - RNA, 1410 nt, Artificial Sequence; identical to SEQ ID NO: 108250
  derived and/or modified sequence opt2 from neuraminidase__InfluenzaA__ADF10361

SEQ ID NO: 110024 - RNA, 1410 nt, Artificial Sequence; identical to SEQ ID NO: 110016
  derived and/or modified sequence opt2 from neuraminidase__InfluenzaA__ADF10371

SEQ ID NO: 110025 - RNA, 1410 nt, Artificial Sequence; identical to SEQ ID NO: 110016
  derived and/or modified sequence opt2 from neuraminidase__InfluenzaA__ADF10407

SEQ ID NO: 110026 - RNA, 1410 nt, Artificial Sequence; identical to SEQ ID NO: 108250
  derived and/or modified sequence opt2 from neuraminidase__InfluenzaA__ADF10472

SEQ ID NO: 110027 - RNA, 1410 nt, Artificial Sequence; identical to SEQ ID NO: 110016
  derived and/or modified sequence opt2 from neuraminidase__InfluenzaA__ADF10616

SEQ ID NO: 110028 - RNA, 1410 nt, Artificial Sequence; identical to SEQ ID NO: 110016
  derived and/or modified sequence opt2 from neuraminidase__InfluenzaA__ADF10688

SEQ ID NO: 110029 - RNA, 1410 nt, Artificial Sequence; identical to SEQ ID NO: 110016
  derived and/or modified sequence opt2 from neuraminidase__InfluenzaA__ADF10726

SEQ ID NO: 110030 - RNA, 1410 nt, Artificial Sequence; identical to SEQ ID NO: 108250
  derived and/or modified sequence opt2 from neuraminidase__InfluenzaA__ADF10773

SEQ ID NO: 110031 - RNA, 1410 nt, Artificial Sequence
  derived and/or modified sequence opt2 from neuraminidase__InfluenzaA__ADF10837
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110032 - RNA, 1410 nt, Artificial Sequence; identical to SEQ ID NO: 108250
  derived and/or modified sequence opt2 from neuraminidase__InfluenzaA__ADF10889

SEQ ID NO: 110033 - RNA, 1410 nt, Artificial Sequence; identical to SEQ ID NO: 108250
  derived and/or modified sequence opt2 from neuraminidase__InfluenzaA__ADF10947

SEQ ID NO: 110034 - RNA, 1410 nt, Artificial Sequence; identical to SEQ ID NO: 108250
  derived and/or modified sequence opt2 from neuraminidase__InfluenzaA__ADF11010

SEQ ID NO: 110035 - RNA, 1410 nt, Artificial Sequence
  derived and/or modified sequence opt2 from neuraminidase__InfluenzaA__ADF27355
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaugggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110036 - RNA, 1410 nt, Artificial Sequence
  derived and/or modified sequence opt2 from neuraminidase__InfluenzaA__ADF27356
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccagaacgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110037 - RNA, 1410 nt, Artificial Sequence; identical to SEQ ID NO: 108604
  derived and/or modified sequence opt2 from neuraminidase__InfluenzaA__ADF27357

SEQ ID NO: 110038 - RNA, 1410 nt, Artificial Sequence; identical to SEQ ID NO: 108604
  derived and/or modified sequence opt2 from neuraminidase__InfluenzaA__ADF27358

SEQ ID NO: 110039 - RNA, 1410 nt, Artificial Sequence; identical to SEQ ID NO: 108604
  derived and/or modified sequence opt2 from neuraminidase__InfluenzaA__ADF27360

SEQ ID NO: 110040 - RNA, 1410 nt, Artificial Sequence; identical to SEQ ID NO: 108250
  derived and/or modified sequence opt2 from neuraminidase__InfluenzaA__ADF27361

SEQ ID NO: 110041 - RNA, 1410 nt, Artificial Sequence; identical to SEQ ID NO: 108250
  derived and/or modified sequence opt2 from neuraminidase__InfluenzaA__ADF27362

SEQ ID NO: 110042 - RNA, 1410 nt, Artificial Sequence; identical to SEQ ID NO: 108250
  derived and/or modified sequence opt2 from neuraminidase__InfluenzaA__ADF27363

SEQ ID NO: 110043 - RNA, 1410 nt, Artificial Sequence; identical to SEQ ID NO: 108604
  derived and/or modified sequence opt2 from neuraminidase__InfluenzaA__ADF27364

SEQ ID NO: 110044 - RNA, 1410 nt, Artificial Sequence; identical to SEQ ID NO: 108250
  derived and/or modified sequence opt2 from neuraminidase__InfluenzaA__ADF27365

SEQ ID NO: 110045 - RNA, 1410 nt, Artificial Sequence; identical to SEQ ID NO: 108604
  derived and/or modified sequence opt2 from neuraminidase__InfluenzaA__ADF27366

SEQ ID NO: 110046 - RNA, 1410 nt, Artificial Sequence; identical to SEQ ID NO: 108250
  derived and/or modified sequence opt2 from neuraminidase__InfluenzaA__ADF27382

SEQ ID NO: 110047 - RNA, 1410 nt, Artificial Sequence; identical to SEQ ID NO: 108250
  derived and/or modified sequence opt2 from neuraminidase__InfluenzaA__ADF27392

SEQ ID NO: 110048 - RNA, 1410 nt, Artificial Sequence; identical to SEQ ID NO: 108250
  derived and/or modified sequence opt2 from neuraminidase__InfluenzaA__ADF27402

SEQ ID NO: 110049 - RNA, 1410 nt, Artificial Sequence; identical to SEQ ID NO: 110031
  derived and/or modified sequence opt2 from neuraminidase__InfluenzaA__ADF27422

SEQ ID NO: 110050 - RNA, 1410 nt, Artificial Sequence
  derived and/or modified sequence opt2 from neuraminidase__InfluenzaA__ADF27432
augaaccccaaccagaagaucaucaccaucggcuccgucugcgucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110051 - RNA, 1410 nt, Artificial Sequence
  derived and/or modified sequence opt2 from neuraminidase__InfluenzaA__ADF27442
augaaccccaaccagaagaucaucaccaucggcuccgucugcaugaccaucggcauggccaaccucauccuccagaucggcaacaucaucuccaucuggaucucccacuccauccagcucgagaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110052 - RNA, 1410 nt, Artificial Sequence
  derived and/or modified sequence opt2 from neuraminidase__InfluenzaA__ADF27462
augaaccccaaccagaagaucaucaccaucggcuccgucugcaugaccaucggcauggccaaccucauccuccagaucggcaacaucaucuccaucuggaucucccacuccauccagcucggcaaccagaaccagaucgaggccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccgucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110053 - RNA, 1410 nt, Artificial Sequence; identical to SEQ ID NO: 108250
  derived and/or modified sequence opt2 from neuraminidase__InfluenzaA__ADF27472

SEQ ID NO: 110054 - RNA, 1410 nt, Artificial Sequence
  derived and/or modified sequence opt2 from neuraminidase__InfluenzaA__ADF27482
augaaccccaaccagaagaucaucaccaucggcuccgucugcaugaccaucggcauggccaaccucauccuccagaucggcaacaucaucuccaucuggaucucccacuccauccagcucggcaaccagaaccaggucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110055 - RNA, 1410 nt, Artificial Sequence
  derived and/or modified sequence opt2 from neuraminidase__InfluenzaA__ADF27492
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagcccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccaucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 110056 - RNA, 1410 nt, Artificial Sequence; identical to SEQ ID NO: 108250
  derived and/or modified sequence opt2 from neuraminidase__InfluenzaA__ADF27502

SEQ ID NO: 110057 - RNA, 1410 nt, Artificial Sequence; identical to SEQ ID NO: 108250
  derived and/or modified sequence opt2 from neuraminidase__InfluenzaA__ADF27512

SEQ ID NO: 110058 - RNA, 1410 nt, Artificial Sequence
  derived and/or modified sequence opt2 from neuraminidase__InfluenzaA__ADF27522
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaucaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110059 - RNA, 1410 nt, Artificial Sequence; identical to SEQ ID NO: 108250
  derived and/or modified sequence opt2 from neuraminidase__InfluenzaA__ADF27532

SEQ ID NO: 110060 - RNA, 1410 nt, Artificial Sequence
  derived and/or modified sequence opt2 from neuraminidase__InfluenzaA__ADF27542
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110061 - RNA, 1410 nt, Artificial Sequence
  derived and/or modified sequence opt2 from neuraminidase__InfluenzaA__ADF27552
augaaccccaaccagaagaucaucaccaucggcuccgucugcaugaccaucggccucgccaaccucauccuccagaucggcaacaucaucuccaucugggucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaagaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110062 - RNA, 1410 nt, Artificial Sequence; identical to SEQ ID NO: 109076
  derived and/or modified sequence opt2 from neuraminidase__InfluenzaA__ADF27562

SEQ ID NO: 110063 - RNA, 1410 nt, Artificial Sequence; identical to SEQ ID NO: 108250
  derived and/or modified sequence opt2 from neuraminidase__InfluenzaA__ADF27572

SEQ ID NO: 110064 - RNA, 1410 nt, Artificial Sequence
  derived and/or modified sequence opt2 from neuraminidase__InfluenzaA__ADF27582
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110065 - RNA, 1410 nt, Artificial Sequence; identical to SEQ ID NO: 108250
  derived and/or modified sequence opt2 from neuraminidase__InfluenzaA__ADF27592

SEQ ID NO: 110066 - RNA, 1410 nt, Artificial Sequence
  derived and/or modified sequence opt2 from neuraminidase__InfluenzaA__ADF27602
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagcgcggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110067 - RNA, 1410 nt, Artificial Sequence; identical to SEQ ID NO: 108250
  derived and/or modified sequence opt2 from neuraminidase__InfluenzaA__ADF27612

SEQ ID NO: 110068 - RNA, 1410 nt, Artificial Sequence; identical to SEQ ID NO: 109538
  derived and/or modified sequence opt2 from neuraminidase__InfluenzaA__ADF27622

SEQ ID NO: 110069 - RNA, 1410 nt, Artificial Sequence; identical to SEQ ID NO: 109985
  derived and/or modified sequence opt2 from neuraminidase__InfluenzaA__ADF27632

SEQ ID NO: 110070 - RNA, 1410 nt, Artificial Sequence; identical to SEQ ID NO: 108250
  derived and/or modified sequence opt2 from neuraminidase__InfluenzaA__ADF27642

SEQ ID NO: 110071 - RNA, 1410 nt, Artificial Sequence; identical to SEQ ID NO: 108250
  derived and/or modified sequence opt2 from neuraminidase__InfluenzaA__ADF27652

SEQ ID NO: 110072 - RNA, 1410 nt, Artificial Sequence
  derived and/or modified sequence opt2 from neuraminidase__InfluenzaA__ADF27662
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugcaacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110073 - RNA, 1410 nt, Artificial Sequence; identical to SEQ ID NO: 108250
  derived and/or modified sequence opt2 from neuraminidase__InfluenzaA__ADF27672

SEQ ID NO: 110074 - RNA, 1410 nt, Artificial Sequence; identical to SEQ ID NO: 108250
  derived and/or modified sequence opt2 from neuraminidase__InfluenzaA__ADF27682

SEQ ID NO: 110075 - RNA, 1410 nt, Artificial Sequence; identical to SEQ ID NO: 108250
  derived and/or modified sequence opt2 from neuraminidase__InfluenzaA__ADF27692

SEQ ID NO: 110076 - RNA, 1410 nt, Artificial Sequence; identical to SEQ ID NO: 108250
  derived and/or modified sequence opt2 from neuraminidase__InfluenzaA__ADF27702

SEQ ID NO: 110077 - RNA, 1410 nt, Artificial Sequence; identical to SEQ ID NO: 108250
  derived and/or modified sequence opt2 from neuraminidase__InfluenzaA__ADF27712

SEQ ID NO: 110078 - RNA, 1410 nt, Artificial Sequence; identical to SEQ ID NO: 109538
  derived and/or modified sequence opt2 from neuraminidase__InfluenzaA__ADF27788

SEQ ID NO: 110079 - RNA, 1410 nt, Artificial Sequence; identical to SEQ ID NO: 109493
  derived and/or modified sequence opt2 from neuraminidase__InfluenzaA__ADF27798

SEQ ID NO: 110080 - RNA, 1410 nt, Artificial Sequence; identical to SEQ ID NO: 109985
  derived and/or modified sequence opt2 from neuraminidase__InfluenzaA__ADF27808

SEQ ID NO: 110081 - RNA, 1410 nt, Artificial Sequence
  derived and/or modified sequence opt2 from neuraminidase__InfluenzaA__ADF27818
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110082 - RNA, 1410 nt, Artificial Sequence; identical to SEQ ID NO: 108250
  derived and/or modified sequence opt2 from neuraminidase__InfluenzaA__ADF27838

SEQ ID NO: 110083 - RNA, 1410 nt, Artificial Sequence; identical to SEQ ID NO: 108250
  derived and/or modified sequence opt2 from neuraminidase__InfluenzaA__ADF27848

SEQ ID NO: 110084 - RNA, 1410 nt, Artificial Sequence
  derived and/or modified sequence opt2 from neuraminidase__InfluenzaA__ADF27858
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccuccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacggcgacaccgucggcugguccuggcccgacggcgccgagcuccccuucaccaucgacaaguga

SEQ ID NO: 110085 - RNA, 1410 nt, Artificial Sequence
  derived and/or modified sequence opt2 from neuraminidase__InfluenzaA__ADF27878
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacggcgacaccgucggcugguccuggcccgacggcgccgagcuccccuucaccaucgacaaguga

SEQ ID NO: 110086 - RNA, 1410 nt, Artificial Sequence; identical to SEQ ID NO: 109538
  derived and/or modified sequence opt2 from neuraminidase__InfluenzaA__ADF27888

SEQ ID NO: 110087 - RNA, 1410 nt, Artificial Sequence; identical to SEQ ID NO: 108250
  derived and/or modified sequence opt2 from neuraminidase__InfluenzaA__ADF27898

SEQ ID NO: 110088 - RNA, 1410 nt, Artificial Sequence; identical to SEQ ID NO: 109538
  derived and/or modified sequence opt2 from neuraminidase__InfluenzaA__ADF27908

SEQ ID NO: 110089 - RNA, 1410 nt, Artificial Sequence; identical to SEQ ID NO: 109538
  derived and/or modified sequence opt2 from neuraminidase__InfluenzaA__ADF27918

SEQ ID NO: 110090 - RNA, 1410 nt, Artificial Sequence
  derived and/or modified sequence opt2 from neuraminidase__InfluenzaA__ADF27938
augaaccccaaccagcgcaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccauguccuucugcggcgucaacuccgacaccgucggcugguccuggcccgacggcgccgagcuccccuucaccaucgacaaguga

SEQ ID NO: 110091 - RNA, 1410 nt, Artificial Sequence; identical to SEQ ID NO: 108250
  derived and/or modified sequence opt2 from neuraminidase__InfluenzaA__ADF27948

SEQ ID NO: 110092 - RNA, 1410 nt, Artificial Sequence; identical to SEQ ID NO: 109538
  derived and/or modified sequence opt2 from neuraminidase__InfluenzaA__ADF27958

SEQ ID NO: 110093 - RNA, 1410 nt, Artificial Sequence; identical to SEQ ID NO: 108250
  derived and/or modified sequence opt2 from neuraminidase__InfluenzaA__ADF27968

SEQ ID NO: 110094 - RNA, 1410 nt, Artificial Sequence; identical to SEQ ID NO: 109538
  derived and/or modified sequence opt2 from neuraminidase__InfluenzaA__ADF27978

SEQ ID NO: 110095 - RNA, 1410 nt, Artificial Sequence
  derived and/or modified sequence opt2 from neuraminidase__InfluenzaA__ADF27988
augaaccccaaccagaagaucaucaccaucggcuccgucugcaugaccaucggccucgccaaccucauccuccagaucggcaacaucaucuccaucuggaucucccacuccauccagcucggcaaccagaaccagaucgagaccugcaaccaguccgucaucuccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaagaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110096 - RNA, 1410 nt, Artificial Sequence; identical to SEQ ID NO: 108250
  derived and/or modified sequence opt2 from neuraminidase__InfluenzaA__ADF27998

SEQ ID NO: 110097 - RNA, 1410 nt, Artificial Sequence; identical to SEQ ID NO: 108250
  derived and/or modified sequence opt2 from neuraminidase__InfluenzaA__ADF28008

SEQ ID NO: 110098 - RNA, 1410 nt, Artificial Sequence; identical to SEQ ID NO: 109137
  derived and/or modified sequence opt2 from neuraminidase__InfluenzaA__ADF28018

SEQ ID NO: 110099 - RNA, 1410 nt, Artificial Sequence; identical to SEQ ID NO: 108250
  derived and/or modified sequence opt2 from neuraminidase__InfluenzaA__ADF28028

SEQ ID NO: 110100 - RNA, 1410 nt, Artificial Sequence
  derived and/or modified sequence opt2 from neuraminidase__InfluenzaA__ADF28038
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccaccggccagcucgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgaccgccacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110101 - RNA, 1410 nt, Artificial Sequence; identical to SEQ ID NO: 108250
  derived and/or modified sequence opt2 from neuraminidase__InfluenzaA__ADF28048

SEQ ID NO: 110102 - RNA, 1410 nt, Artificial Sequence; identical to SEQ ID NO: 108250
  derived and/or modified sequence opt2 from neuraminidase__InfluenzaA__ADF28058

SEQ ID NO: 110103 - RNA, 1410 nt, Artificial Sequence
  derived and/or modified sequence opt2 from neuraminidase__InfluenzaA__ADF28068
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcuccuccucccucugccccgucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110104 - RNA, 1410 nt, Artificial Sequence; identical to SEQ ID NO: 108250
  derived and/or modified sequence opt2 from neuraminidase__InfluenzaA__ADF28078

SEQ ID NO: 110105 - RNA, 1410 nt, Artificial Sequence; identical to SEQ ID NO: 108250
  derived and/or modified sequence opt2 from neuraminidase__InfluenzaA__ADF28088

SEQ ID NO: 110106 - RNA, 1410 nt, Artificial Sequence; identical to SEQ ID NO: 109712
  derived and/or modified sequence opt2 from neuraminidase__InfluenzaA__ADF28110

SEQ ID NO: 110107 - RNA, 1410 nt, Artificial Sequence; identical to SEQ ID NO: 108250
  derived and/or modified sequence opt2 from neuraminidase__InfluenzaA__ADF28120

SEQ ID NO: 110108 - RNA, 1410 nt, Artificial Sequence; identical to SEQ ID NO: 108250
  derived and/or modified sequence opt2 from neuraminidase__InfluenzaA__ADF29919

SEQ ID NO: 110109 - RNA, 1410 nt, Artificial Sequence; identical to SEQ ID NO: 109387
  derived and/or modified sequence opt2 from neuraminidase__InfluenzaA__ADF42692

SEQ ID NO: 110110 - RNA, 1410 nt, Artificial Sequence; identical to SEQ ID NO: 108250
  derived and/or modified sequence opt2 from neuraminidase__InfluenzaA__ADF42702

SEQ ID NO: 110111 - RNA, 1410 nt, Artificial Sequence; identical to SEQ ID NO: 110085
  derived and/or modified sequence opt2 from neuraminidase__InfluenzaA__ADF42712

SEQ ID NO: 110112 - RNA, 1410 nt, Artificial Sequence; identical to SEQ ID NO: 108250
  derived and/or modified sequence opt2 from neuraminidase__InfluenzaA__ADF42722

SEQ ID NO: 110113 - RNA, 1410 nt, Artificial Sequence; identical to SEQ ID NO: 109538
  derived and/or modified sequence opt2 from neuraminidase__InfluenzaA__ADF42732

SEQ ID NO: 110114 - RNA, 1410 nt, Artificial Sequence; identical to SEQ ID NO: 108250
  derived and/or modified sequence opt2 from neuraminidase__InfluenzaA__ADF42742

SEQ ID NO: 110115 - RNA, 1410 nt, Artificial Sequence; identical to SEQ ID NO: 108240
  derived and/or modified sequence opt2 from neuraminidase__InfluenzaA__ADF58339

SEQ ID NO: 110116 - RNA, 1410 nt, Artificial Sequence; identical to SEQ ID NO: 108250
  derived and/or modified sequence opt2 from neuraminidase__InfluenzaA__ADF58348

SEQ ID NO: 110117 - RNA, 1410 nt, Artificial Sequence; identical to SEQ ID NO: 108250
  derived and/or modified sequence opt2 from neuraminidase__InfluenzaA__ADF58350

SEQ ID NO: 110118 - RNA, 1410 nt, Artificial Sequence; identical to SEQ ID NO: 108250
  derived and/or modified sequence opt2 from neuraminidase__InfluenzaA__ADF58352

SEQ ID NO: 110119 - RNA, 1410 nt, Artificial Sequence
  derived and/or modified sequence opt2 from neuraminidase__InfluenzaA__ADF80459
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucaccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 110120 - RNA, 1410 nt, Artificial Sequence
  derived and/or modified sequence opt2 from neuraminidase__InfluenzaA__ADF80503
augaaccccaaccagaagaucaucaccaucggcuccgucugcaugaccaucggcauggccaaccucauccuccagaucggcaacaucaccuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110121 - RNA, 1410 nt, Artificial Sequence
  derived and/or modified sequence opt2 from neuraminidase__InfluenzaA__ADF83744
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110122 - RNA, 1410 nt, Artificial Sequence; identical to SEQ ID NO: 109104
  derived and/or modified sequence opt2 from neuraminidase__InfluenzaA__ADF83755

SEQ ID NO: 110123 - RNA, 1410 nt, Artificial Sequence
  derived and/or modified sequence opt2 from neuraminidase__InfluenzaA__ADF83766
augaaccccaaccagaagaucaucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacgacaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110124 - RNA, 1410 nt, Artificial Sequence; identical to SEQ ID NO: 108250
  derived and/or modified sequence opt2 from neuraminidase__InfluenzaA__ADF83776

SEQ ID NO: 110125 - RNA, 1410 nt, Artificial Sequence
  derived and/or modified sequence opt2 from neuraminidase__InfluenzaA__ADF83786
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacggcgacaccgucggcugguccuggcccgacggcgccgagcuccccuucaccaucgacaaguga

SEQ ID NO: 110126 - RNA, 1410 nt, Artificial Sequence
  derived and/or modified sequence opt2 from neuraminidase__InfluenzaA__ADF83796
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucguccgcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110127 - RNA, 1410 nt, Artificial Sequence; identical to SEQ ID NO: 108250
  derived and/or modified sequence opt2 from neuraminidase__InfluenzaA__ADF83806

SEQ ID NO: 110128 - RNA, 1410 nt, Artificial Sequence; identical to SEQ ID NO: 109763
  derived and/or modified sequence opt2 from neuraminidase__InfluenzaA__ADF83816

SEQ ID NO: 110129 - RNA, 1410 nt, Artificial Sequence; identical to SEQ ID NO: 108250
  derived and/or modified sequence opt2 from neuraminidase__InfluenzaA__ADF83826

SEQ ID NO: 110130 - RNA, 1410 nt, Artificial Sequence; identical to SEQ ID NO: 108250
  derived and/or modified sequence opt2 from neuraminidase__InfluenzaA__ADF83836

SEQ ID NO: 110131 - RNA, 1410 nt, Artificial Sequence; identical to SEQ ID NO: 108250
  derived and/or modified sequence opt2 from neuraminidase__InfluenzaA__ADF83846

SEQ ID NO: 110132 - RNA, 1410 nt, Artificial Sequence; identical to SEQ ID NO: 108250
  derived and/or modified sequence opt2 from neuraminidase__InfluenzaA__ADF83856

SEQ ID NO: 110133 - RNA, 1410 nt, Artificial Sequence; identical to SEQ ID NO: 109601
  derived and/or modified sequence opt2 from neuraminidase__InfluenzaA__ADF83866

SEQ ID NO: 110134 - RNA, 1410 nt, Artificial Sequence; identical to SEQ ID NO: 110031
  derived and/or modified sequence opt2 from neuraminidase__InfluenzaA__ADF83876

SEQ ID NO: 110135 - RNA, 1410 nt, Artificial Sequence; identical to SEQ ID NO: 109681
  derived and/or modified sequence opt2 from neuraminidase__InfluenzaA__ADF83888

SEQ ID NO: 110136 - RNA, 1410 nt, Artificial Sequence
  derived and/or modified sequence opt2 from neuraminidase__InfluenzaA__ADF83898
augaaccccaaccagaagaucaucaccaucggcuccgucugcaugaccaucggcauggccaaccucauccuccagaucggcaacaucaucuccaucuggaucucccaccccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110137 - RNA, 1410 nt, Artificial Sequence; identical to SEQ ID NO: 108250
  derived and/or modified sequence opt2 from neuraminidase__InfluenzaA__ADF83908

SEQ ID NO: 110138 - RNA, 1410 nt, Artificial Sequence; identical to SEQ ID NO: 108250
  derived and/or modified sequence opt2 from neuraminidase__InfluenzaA__ADF83918

SEQ ID NO: 110139 - RNA, 1410 nt, Artificial Sequence; identical to SEQ ID NO: 108250
  derived and/or modified sequence opt2 from neuraminidase__InfluenzaA__ADF84444

SEQ ID NO: 110140 - RNA, 1410 nt, Artificial Sequence; identical to SEQ ID NO: 108250
  derived and/or modified sequence opt2 from neuraminidase__InfluenzaA__ADF84462

SEQ ID NO: 110141 - RNA, 1410 nt, Artificial Sequence
  derived and/or modified sequence opt2 from neuraminidase__InfluenzaA__ADF84472
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110142 - RNA, 1410 nt, Artificial Sequence
  derived and/or modified sequence opt2 from neuraminidase__InfluenzaA__ADF84482
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucgccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucuccugguccuggcccgacggcgccgagcuccccuucaccaucgacaaguga

SEQ ID NO: 110143 - RNA, 1410 nt, Artificial Sequence
  derived and/or modified sequence opt2 from neuraminidase__InfluenzaA__ADF84492
augaaccccaaccagaagaucaucaccaucggcuccgucugcaugaccaucggcauggccaaccucauccuccagaucggcaacaucaucuccaucuggaucucccacuccauccagcucggcaaccaggaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110144 - RNA, 1410 nt, Artificial Sequence; identical to SEQ ID NO: 109357
  derived and/or modified sequence opt2 from neuraminidase__InfluenzaA__ADF85020

SEQ ID NO: 110145 - RNA, 1410 nt, Artificial Sequence; identical to SEQ ID NO: 108250
  derived and/or modified sequence opt2 from neuraminidase__InfluenzaA__ADF87155

SEQ ID NO: 110146 - RNA, 1410 nt, Artificial Sequence
  derived and/or modified sequence opt2 from neuraminidase__InfluenzaA__ADF87165
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgacaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucgccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110147 - RNA, 1410 nt, Artificial Sequence; identical to SEQ ID NO: 110141
  derived and/or modified sequence opt2 from neuraminidase__InfluenzaA__ADF87175

SEQ ID NO: 110148 - RNA, 1410 nt, Artificial Sequence; identical to SEQ ID NO: 108250
  derived and/or modified sequence opt2 from neuraminidase__InfluenzaA__ADF87185

SEQ ID NO: 110149 - RNA, 1410 nt, Artificial Sequence; identical to SEQ ID NO: 110141
  derived and/or modified sequence opt2 from neuraminidase__InfluenzaA__ADF87195

SEQ ID NO: 110150 - RNA, 1410 nt, Artificial Sequence; identical to SEQ ID NO: 108250
  derived and/or modified sequence opt2 from neuraminidase__InfluenzaA__ADF87205

SEQ ID NO: 110151 - RNA, 1410 nt, Artificial Sequence; identical to SEQ ID NO: 108250
  derived and/or modified sequence opt2 from neuraminidase__InfluenzaA__ADF87215

SEQ ID NO: 110152 - RNA, 1410 nt, Artificial Sequence
  derived and/or modified sequence opt2 from neuraminidase__InfluenzaA__ADF87235
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110153 - RNA, 1410 nt, Artificial Sequence; identical to SEQ ID NO: 110141
  derived and/or modified sequence opt2 from neuraminidase__InfluenzaA__ADF87245

SEQ ID NO: 110154 - RNA, 1410 nt, Artificial Sequence; identical to SEQ ID NO: 110141
  derived and/or modified sequence opt2 from neuraminidase__InfluenzaA__ADF87265

SEQ ID NO: 110155 - RNA, 1410 nt, Artificial Sequence
  derived and/or modified sequence opt2 from neuraminidase__InfluenzaA__ADF87285
augaaccccaaccagaagaucaucaccaucggcuccgucugcauguccaucggcauggccaaccucauccuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaugaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110156 - RNA, 1410 nt, Artificial Sequence; identical to SEQ ID NO: 108250
  derived and/or modified sequence opt2 from neuraminidase__InfluenzaA__ADF87295

SEQ ID NO: 110157 - RNA, 1410 nt, Artificial Sequence; identical to SEQ ID NO: 108250
  derived and/or modified sequence opt2 from neuraminidase__InfluenzaA__ADF87305

SEQ ID NO: 110158 - RNA, 1410 nt, Artificial Sequence; identical to SEQ ID NO: 108250
  derived and/or modified sequence opt2 from neuraminidase__InfluenzaA__ADF87334

SEQ ID NO: 110159 - RNA, 1410 nt, Artificial Sequence; identical to SEQ ID NO: 108250
  derived and/or modified sequence opt2 from neuraminidase__InfluenzaA__ADF87344

SEQ ID NO: 110160 - RNA, 1410 nt, Artificial Sequence
  derived and/or modified sequence opt2 from neuraminidase__InfluenzaA__ADF87354
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacuacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110161 - RNA, 1410 nt, Artificial Sequence; identical to SEQ ID NO: 108833
  derived and/or modified sequence opt2 from neuraminidase__InfluenzaA__ADF87364

SEQ ID NO: 110162 - RNA, 1410 nt, Artificial Sequence; identical to SEQ ID NO: 108250
  derived and/or modified sequence opt2 from neuraminidase__InfluenzaA__ADF87374

SEQ ID NO: 110163 - RNA, 1410 nt, Artificial Sequence
  derived and/or modified sequence opt2 from neuraminidase__InfluenzaA__ADF87384
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110164 - RNA, 1410 nt, Artificial Sequence; identical to SEQ ID NO: 108250
  derived and/or modified sequence opt2 from neuraminidase__InfluenzaA__ADF97251

SEQ ID NO: 110165 - RNA, 1410 nt, Artificial Sequence; identical to SEQ ID NO: 109493
  derived and/or modified sequence opt2 from neuraminidase__InfluenzaA__ADF97252

SEQ ID NO: 110166 - RNA, 1410 nt, Artificial Sequence; identical to SEQ ID NO: 108250
  derived and/or modified sequence opt2 from neuraminidase__InfluenzaA__ADF97253

SEQ ID NO: 110167 - RNA, 1410 nt, Artificial Sequence; identical to SEQ ID NO: 108250
  derived and/or modified sequence opt2 from neuraminidase__InfluenzaA__ADF97254

SEQ ID NO: 110168 - RNA, 1410 nt, Artificial Sequence
  derived and/or modified sequence opt2 from neuraminidase__InfluenzaA__ADF97255
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaaccacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110169 - RNA, 1410 nt, Artificial Sequence; identical to SEQ ID NO: 108250
  derived and/or modified sequence opt2 from neuraminidase__InfluenzaA__ADF97256

SEQ ID NO: 110170 - RNA, 1410 nt, Artificial Sequence; identical to SEQ ID NO: 108250
  derived and/or modified sequence opt2 from neuraminidase__InfluenzaA__ADF97257

SEQ ID NO: 110171 - RNA, 1410 nt, Artificial Sequence; identical to SEQ ID NO: 108604
  derived and/or modified sequence opt2 from neuraminidase__InfluenzaA__ADF97837

SEQ ID NO: 110172 - RNA, 1410 nt, Artificial Sequence; identical to SEQ ID NO: 108250
  derived and/or modified sequence opt2 from neuraminidase__InfluenzaA__ADG08120

SEQ ID NO: 110173 - RNA, 1350 nt, Artificial Sequence
  derived and/or modified sequence opt2 from neuraminidase__InfluenzaA__ADG21408
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaaccucucccucugccccgucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110174 - RNA, 1350 nt, Artificial Sequence; identical to SEQ ID NO: 108535
  derived and/or modified sequence opt2 from neuraminidase__InfluenzaA__ADG21409

SEQ ID NO: 110175 - RNA, 1350 nt, Artificial Sequence; identical to SEQ ID NO: 108535
  derived and/or modified sequence opt2 from neuraminidase__InfluenzaA__ADG21415

SEQ ID NO: 110176 - RNA, 1350 nt, Artificial Sequence; identical to SEQ ID NO: 108535
  derived and/or modified sequence opt2 from neuraminidase__InfluenzaA__ADG21417

SEQ ID NO: 110177 - RNA, 1350 nt, Artificial Sequence
  derived and/or modified sequence opt2 from neuraminidase__InfluenzaA__ADG21419
augaaccccaaccagaagaucaucaccaucggcuccaucugcauggucaucggcaucgucucccucaugcuccagaucggcaacaugaucuccaucugggucucccacuccauccagaccggcaaccagugccaggacgaguccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110178 - RNA, 1350 nt, Artificial Sequence
  derived and/or modified sequence opt2 from neuraminidase__InfluenzaA__ADG21423
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacuccuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110179 - RNA, 1350 nt, Artificial Sequence
  derived and/or modified sequence opt2 from neuraminidase__InfluenzaA__ADG21424
augaaccccaaccagaagaucaucaccaucggcuccaucugcauggucaucggcaucgccucccucaugcuccagaucggcaacaugaucuccaucugggucucccacuccauccagaccggcaaccagugccaggacgaguccaucuccaacaccaaguuccucaccgagaaggccgucgccuccgucacccucgccggcaacuccucccucugccccaucuccggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110180 - RNA, 1350 nt, Artificial Sequence
  derived and/or modified sequence opt2 from neuraminidase__InfluenzaA__ADG21426
augaaccccaaccagaagaucaucaccaucggcuccaucugcauggucaucggcaucgucucccucaugcuccagaucggcaacaugaucuccaucugggucucccacuccauccagaccgagaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccguccgccaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110181 - RNA, 1350 nt, Artificial Sequence
  derived and/or modified sequence opt2 from neuraminidase__InfluenzaA__ADG21428
augaaccccaaccagaagaucaucaccaucggcuccaucugcauggucaucggcaucgucucccucaugcuccagaucggcaacaugaucuccaucugggucucccaccccauccagaccggcaaccagugccaggacaagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacuccaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110182 - RNA, 1350 nt, Artificial Sequence; identical to SEQ ID NO: 108535
  derived and/or modified sequence opt2 from neuraminidase__InfluenzaA__ADG21430

SEQ ID NO: 110183 - RNA, 1350 nt, Artificial Sequence
  derived and/or modified sequence opt2 from neuraminidase__InfluenzaA__ADG21432
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuuccgcuacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110184 - RNA, 1350 nt, Artificial Sequence
  derived and/or modified sequence opt2 from neuraminidase__InfluenzaA__ADG21438
augaaccccaaccagaagaucaucaccaucggcuccaucugcauggucaucggcaucgucucccucaugcuccagaucggcaacaugaucuccaucuggaucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcuccggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110185 - RNA, 1350 nt, Artificial Sequence
  derived and/or modified sequence opt2 from neuraminidase__InfluenzaA__ADG21440
augaaccccaaccagaagaucaucaccaucggcuccaucugcauggucaucggcaucgccucccucaugcuccagaucggcaacaugaucuccaucugggucucccacuccauccagaccggcaaccagugccaggacgaguccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110186 - RNA, 1350 nt, Artificial Sequence; identical to SEQ ID NO: 108535
  derived and/or modified sequence opt2 from neuraminidase__InfluenzaA__ADG21442

SEQ ID NO: 110187 - RNA, 1350 nt, Artificial Sequence
  derived and/or modified sequence opt2 from neuraminidase__InfluenzaA__ADG21444
augaaccccaaccagaagaucaucaccaucggcuccaucugcauggucaucggcaucgucucccucaugcuccagaucggcaacaugaucuccaucugggucucccacuccauccagaccggcaaccagugccaggacgaguccaucuccaacaccaaguuccucaccgagaaggccgucaccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccuggaucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110188 - RNA, 1350 nt, Artificial Sequence; identical to SEQ ID NO: 108535
  derived and/or modified sequence opt2 from neuraminidase__InfluenzaA__ADG21446

SEQ ID NO: 110189 - RNA, 1350 nt, Artificial Sequence
  derived and/or modified sequence opt2 from neuraminidase__InfluenzaA__ADG21448
augaaccccaaccagaagaucaucaccaucggcuccaucugcauggucaucggcaucgucucccucaugcuccagaucggcaacaugaucuccaucugggucucccacuccauccagaccggcaaccagugccaggacgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacaucaugcgcacccaggaguccgagugcgccugcgucaacggcuccugcuucaccgucaugaccgacggccccuccuccggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccuggaucuccuucaaccagaaccucgaguaccagaucggcuacaucugcuccggcgucuucggcgacaacccccgccccaacgacggcaccggcuccugcggccccgucuuccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacggcgacaccgucuccugguccuggcccgacggcgccgagcuccccuucaccaucgacaaguga

SEQ ID NO: 110190 - RNA, 1350 nt, Artificial Sequence; identical to SEQ ID NO: 110189
  derived and/or modified sequence opt2 from neuraminidase__InfluenzaA__ADG21450

SEQ ID NO: 110191 - RNA, 1410 nt, Artificial Sequence; identical to SEQ ID NO: 108250
  derived and/or modified sequence opt2 from neuraminidase__InfluenzaA__ADG27797

SEQ ID NO: 110192 - RNA, 1410 nt, Artificial Sequence
  derived and/or modified sequence opt2 from neuraminidase__InfluenzaA__ADG27983
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaaccaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccaugggcugguccuggcccgacggcgccgagcuccccuucaccaucgacaaguga

SEQ ID NO: 110193 - RNA, 1410 nt, Artificial Sequence; identical to SEQ ID NO: 108250
  derived and/or modified sequence opt2 from neuraminidase__InfluenzaA__ADG27989

SEQ ID NO: 110194 - RNA, 1410 nt, Artificial Sequence; identical to SEQ ID NO: 110192
  derived and/or modified sequence opt2 from neuraminidase__InfluenzaA__ADG27998

SEQ ID NO: 110195 - RNA, 1410 nt, Artificial Sequence; identical to SEQ ID NO: 108604
  derived and/or modified sequence opt2 from neuraminidase__InfluenzaA__ADG28013

SEQ ID NO: 110196 - RNA, 1410 nt, Artificial Sequence; identical to SEQ ID NO: 108250
  derived and/or modified sequence opt2 from neuraminidase__InfluenzaA__ADG42086

SEQ ID NO: 110197 - RNA, 1410 nt, Artificial Sequence; identical to SEQ ID NO: 108250
  derived and/or modified sequence opt2 from neuraminidase__InfluenzaA__ADG42096

SEQ ID NO: 110198 - RNA, 1410 nt, Artificial Sequence; identical to SEQ ID NO: 109827
  derived and/or modified sequence opt2 from neuraminidase__InfluenzaA__ADG42106

SEQ ID NO: 110199 - RNA, 1410 nt, Artificial Sequence; identical to SEQ ID NO: 108250
  derived and/or modified sequence opt2 from neuraminidase__InfluenzaA__ADG42116

SEQ ID NO: 110200 - RNA, 1410 nt, Artificial Sequence; identical to SEQ ID NO: 108250
  derived and/or modified sequence opt2 from neuraminidase__InfluenzaA__ADG42126

SEQ ID NO: 110201 - RNA, 1410 nt, Artificial Sequence; identical to SEQ ID NO: 108250
  derived and/or modified sequence opt2 from neuraminidase__InfluenzaA__ADG42136

SEQ ID NO: 110202 - RNA, 1410 nt, Artificial Sequence; identical to SEQ ID NO: 108833
  derived and/or modified sequence opt2 from neuraminidase__InfluenzaA__ADG42146

SEQ ID NO: 110203 - RNA, 1410 nt, Artificial Sequence; identical to SEQ ID NO: 108250
  derived and/or modified sequence opt2 from neuraminidase__InfluenzaA__ADG42156

SEQ ID NO: 110204 - RNA, 1410 nt, Artificial Sequence; identical to SEQ ID NO: 108250
  derived and/or modified sequence opt2 from neuraminidase__InfluenzaA__ADG42166

SEQ ID NO: 110205 - RNA, 1410 nt, Artificial Sequence; identical to SEQ ID NO: 108250
  derived and/or modified sequence opt2 from neuraminidase__InfluenzaA__ADG42186

SEQ ID NO: 110206 - RNA, 1410 nt, Artificial Sequence; identical to SEQ ID NO: 110141
  derived and/or modified sequence opt2 from neuraminidase__InfluenzaA__ADG42196

SEQ ID NO: 110207 - RNA, 1410 nt, Artificial Sequence
  derived and/or modified sequence opt2 from neuraminidase__InfluenzaA__ADG42206
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccaagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110208 - RNA, 1410 nt, Artificial Sequence; identical to SEQ ID NO: 108250
  derived and/or modified sequence opt2 from neuraminidase__InfluenzaA__ADG42216

SEQ ID NO: 110209 - RNA, 1410 nt, Artificial Sequence; identical to SEQ ID NO: 109601
  derived and/or modified sequence opt2 from neuraminidase__InfluenzaA__ADG42226

SEQ ID NO: 110210 - RNA, 1410 nt, Artificial Sequence; identical to SEQ ID NO: 108250
  derived and/or modified sequence opt2 from neuraminidase__InfluenzaA__ADG42236

SEQ ID NO: 110211 - RNA, 1410 nt, Artificial Sequence; identical to SEQ ID NO: 108250
  derived and/or modified sequence opt2 from neuraminidase__InfluenzaA__ADG42246

SEQ ID NO: 110212 - RNA, 1410 nt, Artificial Sequence; identical to SEQ ID NO: 108250
  derived and/or modified sequence opt2 from neuraminidase__InfluenzaA__ADG42256

SEQ ID NO: 110213 - RNA, 1410 nt, Artificial Sequence; identical to SEQ ID NO: 108250
  derived and/or modified sequence opt2 from neuraminidase__InfluenzaA__ADG42276

SEQ ID NO: 110214 - RNA, 1410 nt, Artificial Sequence
  derived and/or modified sequence opt2 from neuraminidase__InfluenzaA__ADG42296
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcgcccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110215 - RNA, 1410 nt, Artificial Sequence; identical to SEQ ID NO: 108250
  derived and/or modified sequence opt2 from neuraminidase__InfluenzaA__ADG42306

SEQ ID NO: 110216 - RNA, 1410 nt, Artificial Sequence; identical to SEQ ID NO: 108250
  derived and/or modified sequence opt2 from neuraminidase__InfluenzaA__ADG42316

SEQ ID NO: 110217 - RNA, 1410 nt, Artificial Sequence; identical to SEQ ID NO: 108250
  derived and/or modified sequence opt2 from neuraminidase__InfluenzaA__ADG42326

SEQ ID NO: 110218 - RNA, 1410 nt, Artificial Sequence
  derived and/or modified sequence opt2 from neuraminidase__InfluenzaA__ADG42336
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110219 - RNA, 1410 nt, Artificial Sequence; identical to SEQ ID NO: 109712
  derived and/or modified sequence opt2 from neuraminidase__InfluenzaA__ADG42346

SEQ ID NO: 110220 - RNA, 1410 nt, Artificial Sequence; identical to SEQ ID NO: 109427
  derived and/or modified sequence opt2 from neuraminidase__InfluenzaA__ADG42356

SEQ ID NO: 110221 - RNA, 1410 nt, Artificial Sequence
  derived and/or modified sequence opt2 from neuraminidase__InfluenzaA__ADG42366
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccuggaucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110222 - RNA, 1410 nt, Artificial Sequence; identical to SEQ ID NO: 108250
  derived and/or modified sequence opt2 from neuraminidase__InfluenzaA__ADG42376

SEQ ID NO: 110223 - RNA, 1410 nt, Artificial Sequence
  derived and/or modified sequence opt2 from neuraminidase__InfluenzaA__ADG42386
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaguucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110224 - RNA, 1410 nt, Artificial Sequence; identical to SEQ ID NO: 110207
  derived and/or modified sequence opt2 from neuraminidase__InfluenzaA__ADG42396

SEQ ID NO: 110225 - RNA, 1410 nt, Artificial Sequence
  derived and/or modified sequence opt2 from neuraminidase__InfluenzaA__ADG42406
augaaccccaaccagaagaucaucaccaucggcuccgucugcaugaccaucggcauggccaaccucauccuccagaucggcaacauccucuccaccuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110226 - RNA, 1410 nt, Artificial Sequence; identical to SEQ ID NO: 109427
  derived and/or modified sequence opt2 from neuraminidase__InfluenzaA__ADG42426

SEQ ID NO: 110227 - RNA, 1410 nt, Artificial Sequence; identical to SEQ ID NO: 108250
  derived and/or modified sequence opt2 from neuraminidase__InfluenzaA__ADG42436

SEQ ID NO: 110228 - RNA, 1410 nt, Artificial Sequence
  derived and/or modified sequence opt2 from neuraminidase__InfluenzaA__ADG42446
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110229 - RNA, 1410 nt, Artificial Sequence
  derived and/or modified sequence opt2 from neuraminidase__InfluenzaA__ADG42456
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110230 - RNA, 1410 nt, Artificial Sequence; identical to SEQ ID NO: 108250
  derived and/or modified sequence opt2 from neuraminidase__InfluenzaA__ADG42466

SEQ ID NO: 110231 - RNA, 1410 nt, Artificial Sequence
  derived and/or modified sequence opt2 from neuraminidase__InfluenzaA__ADG42476
augaaccccaaccagaagaucaucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110232 - RNA, 1410 nt, Artificial Sequence; identical to SEQ ID NO: 110152
  derived and/or modified sequence opt2 from neuraminidase__InfluenzaA__ADG42486

SEQ ID NO: 110233 - RNA, 1410 nt, Artificial Sequence; identical to SEQ ID NO: 108250
  derived and/or modified sequence opt2 from neuraminidase__InfluenzaA__ADG42496

SEQ ID NO: 110234 - RNA, 1410 nt, Artificial Sequence
  derived and/or modified sequence opt2 from neuraminidase__InfluenzaA__ADG42506
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaaggucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110235 - RNA, 1410 nt, Artificial Sequence; identical to SEQ ID NO: 109425
  derived and/or modified sequence opt2 from neuraminidase__InfluenzaA__ADG42516

SEQ ID NO: 110236 - RNA, 1410 nt, Artificial Sequence
  derived and/or modified sequence opt2 from neuraminidase__InfluenzaA__ADG42526
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugccucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110237 - RNA, 1410 nt, Artificial Sequence
  derived and/or modified sequence opt2 from neuraminidase__InfluenzaA__ADG42536
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaccuccgacaccgucggcugguccuggcccgacggcgccgagcuccccuucaccaucgacaaguga

SEQ ID NO: 110238 - RNA, 1410 nt, Artificial Sequence; identical to SEQ ID NO: 108250
  derived and/or modified sequence opt2 from neuraminidase__InfluenzaA__ADG42546

SEQ ID NO: 110239 - RNA, 1410 nt, Artificial Sequence; identical to SEQ ID NO: 108250
  derived and/or modified sequence opt2 from neuraminidase__InfluenzaA__ADG42556

SEQ ID NO: 110240 - RNA, 1410 nt, Artificial Sequence
  derived and/or modified sequence opt2 from neuraminidase__InfluenzaA__ADG42566
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccacuccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110241 - RNA, 1410 nt, Artificial Sequence
  derived and/or modified sequence opt2 from neuraminidase__InfluenzaA__ADG42576
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccuacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110242 - RNA, 1410 nt, Artificial Sequence; identical to SEQ ID NO: 108250
  derived and/or modified sequence opt2 from neuraminidase__InfluenzaA__ADG42586

SEQ ID NO: 110243 - RNA, 1410 nt, Artificial Sequence
  derived and/or modified sequence opt2 from neuraminidase__InfluenzaA__ADG42606
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuuccccaucgacaaguga

SEQ ID NO: 110244 - RNA, 1410 nt, Artificial Sequence
  derived and/or modified sequence opt2 from neuraminidase__InfluenzaA__ADG42616
augaacuccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110245 - RNA, 1410 nt, Artificial Sequence; identical to SEQ ID NO: 108833
  derived and/or modified sequence opt2 from neuraminidase__InfluenzaA__ADG42626

SEQ ID NO: 110246 - RNA, 1410 nt, Artificial Sequence; identical to SEQ ID NO: 110231
  derived and/or modified sequence opt2 from neuraminidase__InfluenzaA__ADG42636

SEQ ID NO: 110247 - RNA, 1410 nt, Artificial Sequence
  derived and/or modified sequence opt2 from neuraminidase__InfluenzaA__ADG42646
augaaccccaaccagcgcaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110248 - RNA, 1410 nt, Artificial Sequence; identical to SEQ ID NO: 108250
  derived and/or modified sequence opt2 from neuraminidase__InfluenzaA__ADG42656

SEQ ID NO: 110249 - RNA, 1410 nt, Artificial Sequence; identical to SEQ ID NO: 110163
  derived and/or modified sequence opt2 from neuraminidase__InfluenzaA__ADG42666

SEQ ID NO: 110250 - RNA, 1410 nt, Artificial Sequence
  derived and/or modified sequence opt2 from neuraminidase__InfluenzaA__ADG42676
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaucugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110251 - RNA, 1410 nt, Artificial Sequence; identical to SEQ ID NO: 108250
  derived and/or modified sequence opt2 from neuraminidase__InfluenzaA__ADG42686

SEQ ID NO: 110252 - RNA, 1410 nt, Artificial Sequence; identical to SEQ ID NO: 109827
  derived and/or modified sequence opt2 from neuraminidase__InfluenzaA__ADG42696

SEQ ID NO: 110253 - RNA, 1410 nt, Artificial Sequence; identical to SEQ ID NO: 110031
  derived and/or modified sequence opt2 from neuraminidase__InfluenzaA__ADG42706

SEQ ID NO: 110254 - RNA, 1410 nt, Artificial Sequence; identical to SEQ ID NO: 108250
  derived and/or modified sequence opt2 from neuraminidase__InfluenzaA__ADG42716

SEQ ID NO: 110255 - RNA, 1410 nt, Artificial Sequence; identical to SEQ ID NO: 109538
  derived and/or modified sequence opt2 from neuraminidase__InfluenzaA__ADG42726

SEQ ID NO: 110256 - RNA, 1410 nt, Artificial Sequence; identical to SEQ ID NO: 108833
  derived and/or modified sequence opt2 from neuraminidase__InfluenzaA__ADG42746

SEQ ID NO: 110257 - RNA, 1410 nt, Artificial Sequence; identical to SEQ ID NO: 109763
  derived and/or modified sequence opt2 from neuraminidase__InfluenzaA__ADG42756

SEQ ID NO: 110258 - RNA, 1410 nt, Artificial Sequence; identical to SEQ ID NO: 109538
  derived and/or modified sequence opt2 from neuraminidase__InfluenzaA__ADG42766

SEQ ID NO: 110259 - RNA, 1410 nt, Artificial Sequence; identical to SEQ ID NO: 109538
  derived and/or modified sequence opt2 from neuraminidase__InfluenzaA__ADG42776

SEQ ID NO: 110260 - RNA, 1410 nt, Artificial Sequence; identical to SEQ ID NO: 109538
  derived and/or modified sequence opt2 from neuraminidase__InfluenzaA__ADG42796

SEQ ID NO: 110261 - RNA, 1410 nt, Artificial Sequence
  derived and/or modified sequence opt2 from neuraminidase__InfluenzaA__ADG42806
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucuccugguccuggcccgacggcgccgagcuccccuucaccaucgacaaguga

SEQ ID NO: 110262 - RNA, 1410 nt, Artificial Sequence; identical to SEQ ID NO: 108250
  derived and/or modified sequence opt2 from neuraminidase__InfluenzaA__ADG42816

SEQ ID NO: 110263 - RNA, 1410 nt, Artificial Sequence; identical to SEQ ID NO: 108250
  derived and/or modified sequence opt2 from neuraminidase__InfluenzaA__ADG42826

SEQ ID NO: 110264 - RNA, 1410 nt, Artificial Sequence; identical to SEQ ID NO: 108250
  derived and/or modified sequence opt2 from neuraminidase__InfluenzaA__ADG42836

SEQ ID NO: 110265 - RNA, 1410 nt, Artificial Sequence; identical to SEQ ID NO: 109866
  derived and/or modified sequence opt2 from neuraminidase__InfluenzaA__ADG42846

SEQ ID NO: 110266 - RNA, 1410 nt, Artificial Sequence; identical to SEQ ID NO: 108250
  derived and/or modified sequence opt2 from neuraminidase__InfluenzaA__ADG42856

SEQ ID NO: 110267 - RNA, 1410 nt, Artificial Sequence; identical to SEQ ID NO: 109862
  derived and/or modified sequence opt2 from neuraminidase__InfluenzaA__ADG42866

SEQ ID NO: 110268 - RNA, 1410 nt, Artificial Sequence; identical to SEQ ID NO: 108250
  derived and/or modified sequence opt2 from neuraminidase__InfluenzaA__ADG42876

SEQ ID NO: 110269 - RNA, 1410 nt, Artificial Sequence; identical to SEQ ID NO: 109899
  derived and/or modified sequence opt2 from neuraminidase__InfluenzaA__ADG42886

SEQ ID NO: 110270 - RNA, 1410 nt, Artificial Sequence; identical to SEQ ID NO: 109842
  derived and/or modified sequence opt2 from neuraminidase__InfluenzaA__ADG42896

SEQ ID NO: 110271 - RNA, 1410 nt, Artificial Sequence; identical to SEQ ID NO: 109842
  derived and/or modified sequence opt2 from neuraminidase__InfluenzaA__ADG42906

SEQ ID NO: 110272 - RNA, 1410 nt, Artificial Sequence; identical to SEQ ID NO: 108250
  derived and/or modified sequence opt2 from neuraminidase__InfluenzaA__ADG42916

SEQ ID NO: 110273 - RNA, 1410 nt, Artificial Sequence; identical to SEQ ID NO: 108250
  derived and/or modified sequence opt2 from neuraminidase__InfluenzaA__ADG42926

SEQ ID NO: 110274 - RNA, 1410 nt, Artificial Sequence; identical to SEQ ID NO: 108250
  derived and/or modified sequence opt2 from neuraminidase__InfluenzaA__ADG58909

SEQ ID NO: 110275 - RNA, 1410 nt, Artificial Sequence; identical to SEQ ID NO: 108250
  derived and/or modified sequence opt2 from neuraminidase__InfluenzaA__ADG58910

SEQ ID NO: 110276 - RNA, 1410 nt, Artificial Sequence
  derived and/or modified sequence opt2 from neuraminidase__InfluenzaA__ADG58913
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucaccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucuggaucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110277 - RNA, 1410 nt, Artificial Sequence; identical to SEQ ID NO: 108250
  derived and/or modified sequence opt2 from neuraminidase__InfluenzaA__ADG58914

SEQ ID NO: 110278 - RNA, 1410 nt, Artificial Sequence; identical to SEQ ID NO: 108250
  derived and/or modified sequence opt2 from neuraminidase__InfluenzaA__ADG58916

SEQ ID NO: 110279 - RNA, 1410 nt, Artificial Sequence; identical to SEQ ID NO: 108250
  derived and/or modified sequence opt2 from neuraminidase__InfluenzaA__ADG58917

SEQ ID NO: 110280 - RNA, 1410 nt, Artificial Sequence
  derived and/or modified sequence opt2 from neuraminidase__InfluenzaA__ADG58918
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucaccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110281 - RNA, 1410 nt, Artificial Sequence; identical to SEQ ID NO: 110276
  derived and/or modified sequence opt2 from neuraminidase__InfluenzaA__ADG58919

SEQ ID NO: 110282 - RNA, 1410 nt, Artificial Sequence; identical to SEQ ID NO: 108405
  derived and/or modified sequence opt2 from neuraminidase__InfluenzaA__ADG58920

SEQ ID NO: 110283 - RNA, 1410 nt, Artificial Sequence; identical to SEQ ID NO: 108405
  derived and/or modified sequence opt2 from neuraminidase__InfluenzaA__ADG58921

SEQ ID NO: 110284 - RNA, 1410 nt, Artificial Sequence; identical to SEQ ID NO: 108405
  derived and/or modified sequence opt2 from neuraminidase__InfluenzaA__ADG58922

SEQ ID NO: 110285 - RNA, 1410 nt, Artificial Sequence; identical to SEQ ID NO: 108405
  derived and/or modified sequence opt2 from neuraminidase__InfluenzaA__ADG58923

SEQ ID NO: 110286 - RNA, 1410 nt, Artificial Sequence; identical to SEQ ID NO: 108405
  derived and/or modified sequence opt2 from neuraminidase__InfluenzaA__ADG58924

SEQ ID NO: 110287 - RNA, 1410 nt, Artificial Sequence; identical to SEQ ID NO: 108405
  derived and/or modified sequence opt2 from neuraminidase__InfluenzaA__ADG58925

SEQ ID NO: 110288 - RNA, 1410 nt, Artificial Sequence; identical to SEQ ID NO: 108405
  derived and/or modified sequence opt2 from neuraminidase__InfluenzaA__ADG58926

SEQ ID NO: 110289 - RNA, 1410 nt, Artificial Sequence; identical to SEQ ID NO: 108405
  derived and/or modified sequence opt2 from neuraminidase__InfluenzaA__ADG58927

SEQ ID NO: 110290 - RNA, 1410 nt, Artificial Sequence; identical to SEQ ID NO: 109268
  derived and/or modified sequence opt2 from neuraminidase__InfluenzaA__ADG58928

SEQ ID NO: 110291 - RNA, 1410 nt, Artificial Sequence; identical to SEQ ID NO: 109268
  derived and/or modified sequence opt2 from neuraminidase__InfluenzaA__ADG58929

SEQ ID NO: 110292 - RNA, 1410 nt, Artificial Sequence
  derived and/or modified sequence opt2 from neuraminidase__InfluenzaA__ADG58931
augaaccccaaccagaagaucaucaccaucggcuccgucugcaugaccaucggcauggccaaccucauccuccagaucggcaacaccaucuccaucuggaucaaccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110293 - RNA, 1410 nt, Artificial Sequence; identical to SEQ ID NO: 110292
  derived and/or modified sequence opt2 from neuraminidase__InfluenzaA__ADG58932

SEQ ID NO: 110294 - RNA, 1410 nt, Artificial Sequence; identical to SEQ ID NO: 110292
  derived and/or modified sequence opt2 from neuraminidase__InfluenzaA__ADG58933

SEQ ID NO: 110295 - RNA, 1410 nt, Artificial Sequence; identical to SEQ ID NO: 110292
  derived and/or modified sequence opt2 from neuraminidase__InfluenzaA__ADG58934

SEQ ID NO: 110296 - RNA, 1410 nt, Artificial Sequence; identical to SEQ ID NO: 110292
  derived and/or modified sequence opt2 from neuraminidase__InfluenzaA__ADG58935

SEQ ID NO: 110297 - RNA, 1410 nt, Artificial Sequence; identical to SEQ ID NO: 110292
  derived and/or modified sequence opt2 from neuraminidase__InfluenzaA__ADG58936

SEQ ID NO: 110298 - RNA, 1410 nt, Artificial Sequence; identical to SEQ ID NO: 110292
  derived and/or modified sequence opt2 from neuraminidase__InfluenzaA__ADG58937

SEQ ID NO: 110299 - RNA, 1410 nt, Artificial Sequence; identical to SEQ ID NO: 110292
  derived and/or modified sequence opt2 from neuraminidase__InfluenzaA__ADG58938

SEQ ID NO: 110300 - RNA, 1410 nt, Artificial Sequence
  derived and/or modified sequence opt2 from neuraminidase__InfluenzaA__ADG59589
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccauggccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaaggucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110301 - RNA, 1410 nt, Artificial Sequence; identical to SEQ ID NO: 108250
  derived and/or modified sequence opt2 from neuraminidase__InfluenzaA__ADG59590

SEQ ID NO: 110302 - RNA, 1410 nt, Artificial Sequence; identical to SEQ ID NO: 108250
  derived and/or modified sequence opt2 from neuraminidase__InfluenzaA__ADG59591

SEQ ID NO: 110303 - RNA, 1410 nt, Artificial Sequence; identical to SEQ ID NO: 108250
  derived and/or modified sequence opt2 from neuraminidase__InfluenzaA__ADG59592

SEQ ID NO: 110304 - RNA, 1410 nt, Artificial Sequence; identical to SEQ ID NO: 110152
  derived and/or modified sequence opt2 from neuraminidase__InfluenzaA__ADG59593

SEQ ID NO: 110305 - RNA, 1410 nt, Artificial Sequence; identical to SEQ ID NO: 109427
  derived and/or modified sequence opt2 from neuraminidase__InfluenzaA__ADG59594

SEQ ID NO: 110306 - RNA, 1410 nt, Artificial Sequence; identical to SEQ ID NO: 109427
  derived and/or modified sequence opt2 from neuraminidase__InfluenzaA__ADG59595

SEQ ID NO: 110307 - RNA, 1410 nt, Artificial Sequence
  derived and/or modified sequence opt2 from neuraminidase__InfluenzaA__ADG59596
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgaccgcaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110308 - RNA, 1410 nt, Artificial Sequence; identical to SEQ ID NO: 108250
  derived and/or modified sequence opt2 from neuraminidase__InfluenzaA__ADG59597

SEQ ID NO: 110309 - RNA, 1410 nt, Artificial Sequence; identical to SEQ ID NO: 108250
  derived and/or modified sequence opt2 from neuraminidase__InfluenzaA__ADG59598

SEQ ID NO: 110310 - RNA, 1410 nt, Artificial Sequence; identical to SEQ ID NO: 109425
  derived and/or modified sequence opt2 from neuraminidase__InfluenzaA__ADG59599

SEQ ID NO: 110311 - RNA, 1410 nt, Artificial Sequence; identical to SEQ ID NO: 108250
  derived and/or modified sequence opt2 from neuraminidase__InfluenzaA__ADG59601

SEQ ID NO: 110312 - RNA, 1410 nt, Artificial Sequence; identical to SEQ ID NO: 110152
  derived and/or modified sequence opt2 from neuraminidase__InfluenzaA__ADG59602

SEQ ID NO: 110313 - RNA, 1410 nt, Artificial Sequence; identical to SEQ ID NO: 110152
  derived and/or modified sequence opt2 from neuraminidase__InfluenzaA__ADG59603

SEQ ID NO: 110314 - RNA, 1410 nt, Artificial Sequence; identical to SEQ ID NO: 108250
  derived and/or modified sequence opt2 from neuraminidase__InfluenzaA__ADG59604

SEQ ID NO: 110315 - RNA, 1410 nt, Artificial Sequence; identical to SEQ ID NO: 108250
  derived and/or modified sequence opt2 from neuraminidase__InfluenzaA__ADG59605

SEQ ID NO: 110316 - RNA, 1410 nt, Artificial Sequence; identical to SEQ ID NO: 109268
  derived and/or modified sequence opt2 from neuraminidase__InfluenzaA__ADG59606

SEQ ID NO: 110317 - RNA, 1410 nt, Artificial Sequence; identical to SEQ ID NO: 108250
  derived and/or modified sequence opt2 from neuraminidase__InfluenzaA__ADG59607

SEQ ID NO: 110318 - RNA, 1410 nt, Artificial Sequence; identical to SEQ ID NO: 108250
  derived and/or modified sequence opt2 from neuraminidase__InfluenzaA__ADG59608

SEQ ID NO: 110319 - RNA, 1410 nt, Artificial Sequence; identical to SEQ ID NO: 109071
  derived and/or modified sequence opt2 from neuraminidase__InfluenzaA__ADG59609

SEQ ID NO: 110320 - RNA, 1410 nt, Artificial Sequence; identical to SEQ ID NO: 110152
  derived and/or modified sequence opt2 from neuraminidase__InfluenzaA__ADG59610

SEQ ID NO: 110321 - RNA, 1410 nt, Artificial Sequence; identical to SEQ ID NO: 109268
  derived and/or modified sequence opt2 from neuraminidase__InfluenzaA__ADG59611

SEQ ID NO: 110322 - RNA, 1410 nt, Artificial Sequence; identical to SEQ ID NO: 110152
  derived and/or modified sequence opt2 from neuraminidase__InfluenzaA__ADG59612

SEQ ID NO: 110323 - RNA, 1410 nt, Artificial Sequence
  derived and/or modified sequence opt2 from neuraminidase__InfluenzaA__ADG59613
augaaccccaaccagaagaucaucaccaucggcuccgucugcaugaccaucggcaugaccaaccucauccuccagcucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 110324 - RNA, 1410 nt, Artificial Sequence; identical to SEQ ID NO: 109425
  derived and/or modified sequence opt2 from neuraminidase__InfluenzaA__ADG59614

SEQ ID NO: 110325 - RNA, 1410 nt, Artificial Sequence; identical to SEQ ID NO: 108250
  derived and/or modified sequence opt2 from neuraminidase__InfluenzaA__ADH01811

SEQ ID NO: 110326 - RNA, 1410 nt, Artificial Sequence; identical to SEQ ID NO: 108250
  derived and/or modified sequence opt2 from neuraminidase__InfluenzaA__ADH01821

SEQ ID NO: 110327 - RNA, 1410 nt, Artificial Sequence; identical to SEQ ID NO: 108250
  derived and/or modified sequence opt2 from neuraminidase__InfluenzaA__ADH01831

SEQ ID NO: 110328 - RNA, 1410 nt, Artificial Sequence; identical to SEQ ID NO: 108250
  derived and/or modified sequence opt2 from neuraminidase__InfluenzaA__ADH01841

SEQ ID NO: 110329 - RNA, 1410 nt, Artificial Sequence; identical to SEQ ID NO: 108250
  derived and/or modified sequence opt2 from neuraminidase__InfluenzaA__ADH01851

SEQ ID NO: 110330 - RNA, 1410 nt, Artificial Sequence; identical to SEQ ID NO: 108250
  derived and/or modified sequence opt2 from neuraminidase__InfluenzaA__ADH01861

SEQ ID NO: 110331 - RNA, 1410 nt, Artificial Sequence; identical to SEQ ID NO: 108250
  derived and/or modified sequence opt2 from neuraminidase__InfluenzaA__ADH01871

SEQ ID NO: 110332 - RNA, 1410 nt, Artificial Sequence; identical to SEQ ID NO: 108250
  derived and/or modified sequence opt2 from neuraminidase__InfluenzaA__ADH01881

SEQ ID NO: 110333 - RNA, 1410 nt, Artificial Sequence; identical to SEQ ID NO: 108250
  derived and/or modified sequence opt2 from neuraminidase__InfluenzaA__ADH01891

SEQ ID NO: 110334 - RNA, 1410 nt, Artificial Sequence; identical to SEQ ID NO: 108250
  derived and/or modified sequence opt2 from neuraminidase__InfluenzaA__ADH01901

SEQ ID NO: 110335 - RNA, 1410 nt, Artificial Sequence; identical to SEQ ID NO: 108250
  derived and/or modified sequence opt2 from neuraminidase__InfluenzaA__ADH01911

SEQ ID NO: 110336 - RNA, 1410 nt, Artificial Sequence; identical to SEQ ID NO: 108250
  derived and/or modified sequence opt2 from neuraminidase__InfluenzaA__ADH01921

SEQ ID NO: 110337 - RNA, 1410 nt, Artificial Sequence; identical to SEQ ID NO: 108250
  derived and/or modified sequence opt2 from neuraminidase__InfluenzaA__ADH01931

SEQ ID NO: 110338 - RNA, 1410 nt, Artificial Sequence; identical to SEQ ID NO: 110141
  derived and/or modified sequence opt2 from neuraminidase__InfluenzaA__ADH01941

SEQ ID NO: 110339 - RNA, 1410 nt, Artificial Sequence; identical to SEQ ID NO: 108250
  derived and/or modified sequence opt2 from neuraminidase__InfluenzaA__ADH01951

SEQ ID NO: 110340 - RNA, 1410 nt, Artificial Sequence; identical to SEQ ID NO: 108250
  derived and/or modified sequence opt2 from neuraminidase__InfluenzaA__ADH01961

SEQ ID NO: 110341 - RNA, 1410 nt, Artificial Sequence
  derived and/or modified sequence opt2 from neuraminidase__InfluenzaA__ADH01981
augaaccccaaccagaagaucaucaccaucggcuccgccugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110342 - RNA, 1410 nt, Artificial Sequence; identical to SEQ ID NO: 109538
  derived and/or modified sequence opt2 from neuraminidase__InfluenzaA__ADH01991

SEQ ID NO: 110343 - RNA, 1410 nt, Artificial Sequence; identical to SEQ ID NO: 110207
  derived and/or modified sequence opt2 from neuraminidase__InfluenzaA__ADH02011

SEQ ID NO: 110344 - RNA, 1410 nt, Artificial Sequence; identical to SEQ ID NO: 109427
  derived and/or modified sequence opt2 from neuraminidase__InfluenzaA__ADH02021

SEQ ID NO: 110345 - RNA, 1410 nt, Artificial Sequence; identical to SEQ ID NO: 108250
  derived and/or modified sequence opt2 from neuraminidase__InfluenzaA__ADI24510

SEQ ID NO: 110346 - RNA, 1410 nt, Artificial Sequence; identical to SEQ ID NO: 108250
  derived and/or modified sequence opt2 from neuraminidase__InfluenzaA__ADI24516

SEQ ID NO: 110347 - RNA, 1410 nt, Artificial Sequence; identical to SEQ ID NO: 108250
  derived and/or modified sequence opt2 from neuraminidase__InfluenzaA__ADI24518

SEQ ID NO: 110348 - RNA, 1410 nt, Artificial Sequence; identical to SEQ ID NO: 108250
  derived and/or modified sequence opt2 from neuraminidase__InfluenzaA__ADI24522

SEQ ID NO: 110349 - RNA, 1410 nt, Artificial Sequence; identical to SEQ ID NO: 108250
  derived and/or modified sequence opt2 from neuraminidase__InfluenzaA__ADI24524

SEQ ID NO: 110350 - RNA, 1410 nt, Artificial Sequence; identical to SEQ ID NO: 108250
  derived and/or modified sequence opt2 from neuraminidase__InfluenzaA__ADI24526

SEQ ID NO: 110351 - RNA, 1410 nt, Artificial Sequence; identical to SEQ ID NO: 108250
  derived and/or modified sequence opt2 from neuraminidase__InfluenzaA__ADI24528

SEQ ID NO: 110352 - RNA, 1410 nt, Artificial Sequence; identical to SEQ ID NO: 108250
  derived and/or modified sequence opt2 from neuraminidase__InfluenzaA__ADI24530

SEQ ID NO: 110353 - RNA, 1410 nt, Artificial Sequence
  derived and/or modified sequence opt2 from neuraminidase__InfluenzaA__ADI24532
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccuccggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110354 - RNA, 1410 nt, Artificial Sequence; identical to SEQ ID NO: 108250
  derived and/or modified sequence opt2 from neuraminidase__InfluenzaA__ADI24538

SEQ ID NO: 110355 - RNA, 1410 nt, Artificial Sequence; identical to SEQ ID NO: 108250
  derived and/or modified sequence opt2 from neuraminidase__InfluenzaA__ADI24548

SEQ ID NO: 110356 - RNA, 1410 nt, Artificial Sequence; identical to SEQ ID NO: 108250
  derived and/or modified sequence opt2 from neuraminidase__InfluenzaA__ADI24556

SEQ ID NO: 110357 - RNA, 1410 nt, Artificial Sequence; identical to SEQ ID NO: 108250
  derived and/or modified sequence opt2 from neuraminidase__InfluenzaA__ADI24558

SEQ ID NO: 110358 - RNA, 1410 nt, Artificial Sequence; identical to SEQ ID NO: 108250
  derived and/or modified sequence opt2 from neuraminidase__InfluenzaA__ADI24560

SEQ ID NO: 110359 - RNA, 1410 nt, Artificial Sequence; identical to SEQ ID NO: 108250
  derived and/or modified sequence opt2 from neuraminidase__InfluenzaA__ADI24562

SEQ ID NO: 110360 - RNA, 1410 nt, Artificial Sequence; identical to SEQ ID NO: 108250
  derived and/or modified sequence opt2 from neuraminidase__InfluenzaA__ADI24564

SEQ ID NO: 110361 - RNA, 1410 nt, Artificial Sequence; identical to SEQ ID NO: 108250
  derived and/or modified sequence opt2 from neuraminidase__InfluenzaA__ADI24566

SEQ ID NO: 110362 - RNA, 1410 nt, Artificial Sequence; identical to SEQ ID NO: 108250
  derived and/or modified sequence opt2 from neuraminidase__InfluenzaA__ADI24568

SEQ ID NO: 110363 - RNA, 1410 nt, Artificial Sequence; identical to SEQ ID NO: 108250
  derived and/or modified sequence opt2 from neuraminidase__InfluenzaA__ADI24570

SEQ ID NO: 110364 - RNA, 1410 nt, Artificial Sequence; identical to SEQ ID NO: 108250
  derived and/or modified sequence opt2 from neuraminidase__InfluenzaA__ADI24572

SEQ ID NO: 110365 - RNA, 1410 nt, Artificial Sequence; identical to SEQ ID NO: 108250
  derived and/or modified sequence opt2 from neuraminidase__InfluenzaA__ADI24574

SEQ ID NO: 110366 - RNA, 1410 nt, Artificial Sequence; identical to SEQ ID NO: 108250
  derived and/or modified sequence opt2 from neuraminidase__InfluenzaA__ADI24576

SEQ ID NO: 110367 - RNA, 1410 nt, Artificial Sequence; identical to SEQ ID NO: 108250
  derived and/or modified sequence opt2 from neuraminidase__InfluenzaA__ADI24580

SEQ ID NO: 110368 - RNA, 1410 nt, Artificial Sequence; identical to SEQ ID NO: 109425
  derived and/or modified sequence opt2 from neuraminidase__InfluenzaA__ADI24582

SEQ ID NO: 110369 - RNA, 1410 nt, Artificial Sequence
  derived and/or modified sequence opt2 from neuraminidase__InfluenzaA__ADI24584
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110370 - RNA, 1410 nt, Artificial Sequence; identical to SEQ ID NO: 108604
  derived and/or modified sequence opt2 from neuraminidase__InfluenzaA__ADI24592

SEQ ID NO: 110371 - RNA, 1410 nt, Artificial Sequence; identical to SEQ ID NO: 108250
  derived and/or modified sequence opt2 from neuraminidase__InfluenzaA__ADI24598

SEQ ID NO: 110372 - RNA, 1410 nt, Artificial Sequence; identical to SEQ ID NO: 108250
  derived and/or modified sequence opt2 from neuraminidase__InfluenzaA__ADI24604

SEQ ID NO: 110373 - RNA, 1410 nt, Artificial Sequence; identical to SEQ ID NO: 108250
  derived and/or modified sequence opt2 from neuraminidase__InfluenzaA__ADI24620

SEQ ID NO: 110374 - RNA, 1410 nt, Artificial Sequence; identical to SEQ ID NO: 108250
  derived and/or modified sequence opt2 from neuraminidase__InfluenzaA__ADI24622

SEQ ID NO: 110375 - RNA, 1410 nt, Artificial Sequence; identical to SEQ ID NO: 108604
  derived and/or modified sequence opt2 from neuraminidase__InfluenzaA__ADI46780

SEQ ID NO: 110376 - RNA, 1410 nt, Artificial Sequence
  derived and/or modified sequence opt2 from neuraminidase__InfluenzaA__ADI46789
augaaccccaaccagaagaucaucaccaucggcuccgucugcaugaccaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacgagcaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110377 - RNA, 1410 nt, Artificial Sequence; identical to SEQ ID NO: 108250
  derived and/or modified sequence opt2 from neuraminidase__InfluenzaA__ADI48185

SEQ ID NO: 110378 - RNA, 1410 nt, Artificial Sequence; identical to SEQ ID NO: 108250
  derived and/or modified sequence opt2 from neuraminidase__InfluenzaA__ADI48187

SEQ ID NO: 110379 - RNA, 1410 nt, Artificial Sequence; identical to SEQ ID NO: 108250
  derived and/or modified sequence opt2 from neuraminidase__InfluenzaA__ADI48189

SEQ ID NO: 110380 - RNA, 1410 nt, Artificial Sequence; identical to SEQ ID NO: 108250
  derived and/or modified sequence opt2 from neuraminidase__InfluenzaA__ADI48191

SEQ ID NO: 110381 - RNA, 1410 nt, Artificial Sequence; identical to SEQ ID NO: 108250
  derived and/or modified sequence opt2 from neuraminidase__InfluenzaA__ADI48193

SEQ ID NO: 110382 - RNA, 1410 nt, Artificial Sequence; identical to SEQ ID NO: 108250
  derived and/or modified sequence opt2 from neuraminidase__InfluenzaA__ADI48195

SEQ ID NO: 110383 - RNA, 1410 nt, Artificial Sequence
  derived and/or modified sequence opt2 from neuraminidase__InfluenzaA__ADI48197
augaaccccaaccagaagaucaucaccaucggcuccgucugcaugaccaucggcauggccaaccucauccuccagaucggcaacaucaucuccaucuggaucucccacuccauccaguucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110384 - RNA, 1410 nt, Artificial Sequence; identical to SEQ ID NO: 108250
  derived and/or modified sequence opt2 from neuraminidase__InfluenzaA__ADI48199

SEQ ID NO: 110385 - RNA, 1410 nt, Artificial Sequence; identical to SEQ ID NO: 108250
  derived and/or modified sequence opt2 from neuraminidase__InfluenzaA__ADI48201

SEQ ID NO: 110386 - RNA, 1410 nt, Artificial Sequence; identical to SEQ ID NO: 108250
  derived and/or modified sequence opt2 from neuraminidase__InfluenzaA__ADI48203

SEQ ID NO: 110387 - RNA, 1410 nt, Artificial Sequence
  derived and/or modified sequence opt2 from neuraminidase__InfluenzaA__ADI48205
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110388 - RNA, 1410 nt, Artificial Sequence; identical to SEQ ID NO: 108250
  derived and/or modified sequence opt2 from neuraminidase__InfluenzaA__ADI48207

SEQ ID NO: 110389 - RNA, 1410 nt, Artificial Sequence; identical to SEQ ID NO: 108250
  derived and/or modified sequence opt2 from neuraminidase__InfluenzaA__ADI48209

SEQ ID NO: 110390 - RNA, 1410 nt, Artificial Sequence; identical to SEQ ID NO: 108250
  derived and/or modified sequence opt2 from neuraminidase__InfluenzaA__ADI48211

SEQ ID NO: 110391 - RNA, 1410 nt, Artificial Sequence; identical to SEQ ID NO: 108250
  derived and/or modified sequence opt2 from neuraminidase__InfluenzaA__ADI48213

SEQ ID NO: 110392 - RNA, 1410 nt, Artificial Sequence; identical to SEQ ID NO: 108250
  derived and/or modified sequence opt2 from neuraminidase__InfluenzaA__ADI48215

SEQ ID NO: 110393 - RNA, 1410 nt, Artificial Sequence; identical to SEQ ID NO: 108250
  derived and/or modified sequence opt2 from neuraminidase__InfluenzaA__ADI48217

SEQ ID NO: 110394 - RNA, 1410 nt, Artificial Sequence; identical to SEQ ID NO: 108250
  derived and/or modified sequence opt2 from neuraminidase__InfluenzaA__ADI48219

SEQ ID NO: 110395 - RNA, 1410 nt, Artificial Sequence; identical to SEQ ID NO: 108250
  derived and/or modified sequence opt2 from neuraminidase__InfluenzaA__ADI48221

SEQ ID NO: 110396 - RNA, 1410 nt, Artificial Sequence; identical to SEQ ID NO: 108250
  derived and/or modified sequence opt2 from neuraminidase__InfluenzaA__ADI48625

SEQ ID NO: 110397 - RNA, 1410 nt, Artificial Sequence; identical to SEQ ID NO: 108250
  derived and/or modified sequence opt2 from neuraminidase__InfluenzaA__ADI48635

SEQ ID NO: 110398 - RNA, 1410 nt, Artificial Sequence; identical to SEQ ID NO: 108250
  derived and/or modified sequence opt2 from neuraminidase__InfluenzaA__ADI48655

SEQ ID NO: 110399 - RNA, 1410 nt, Artificial Sequence; identical to SEQ ID NO: 108250
  derived and/or modified sequence opt2 from neuraminidase__InfluenzaA__ADI48665

SEQ ID NO: 110400 - RNA, 1410 nt, Artificial Sequence
  derived and/or modified sequence opt2 from neuraminidase__InfluenzaA__ADI48675
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccucaaggagaacaccaucuggaccuccggcuccuccaucuccuucugcggcgucaacuccgacaccgucggcugguccuggcccgacggcgccgagcuccccuucaccaucgacaaguga

SEQ ID NO: 110401 - RNA, 1410 nt, Artificial Sequence
  derived and/or modified sequence opt2 from neuraminidase__InfluenzaA__ADI48685
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcgccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110402 - RNA, 1410 nt, Artificial Sequence; identical to SEQ ID NO: 108250
  derived and/or modified sequence opt2 from neuraminidase__InfluenzaA__ADI48695

SEQ ID NO: 110403 - RNA, 1410 nt, Artificial Sequence; identical to SEQ ID NO: 108240
  derived and/or modified sequence opt2 from neuraminidase__InfluenzaA__ADI48705

SEQ ID NO: 110404 - RNA, 1410 nt, Artificial Sequence; identical to SEQ ID NO: 108250
  derived and/or modified sequence opt2 from neuraminidase__InfluenzaA__ADI48715

SEQ ID NO: 110405 - RNA, 1410 nt, Artificial Sequence; identical to SEQ ID NO: 108250
  derived and/or modified sequence opt2 from neuraminidase__InfluenzaA__ADI48725

SEQ ID NO: 110406 - RNA, 1410 nt, Artificial Sequence; identical to SEQ ID NO: 108250
  derived and/or modified sequence opt2 from neuraminidase__InfluenzaA__ADI48735

SEQ ID NO: 110407 - RNA, 1410 nt, Artificial Sequence; identical to SEQ ID NO: 108250
  derived and/or modified sequence opt2 from neuraminidase__InfluenzaA__ADI48745

SEQ ID NO: 110408 - RNA, 1410 nt, Artificial Sequence
  derived and/or modified sequence opt2 from neuraminidase__InfluenzaA__ADI48755
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucuccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110409 - RNA, 1410 nt, Artificial Sequence; identical to SEQ ID NO: 108250
  derived and/or modified sequence opt2 from neuraminidase__InfluenzaA__ADI48765

SEQ ID NO: 110410 - RNA, 1410 nt, Artificial Sequence; identical to SEQ ID NO: 108250
  derived and/or modified sequence opt2 from neuraminidase__InfluenzaA__ADI48775

SEQ ID NO: 110411 - RNA, 1410 nt, Artificial Sequence; identical to SEQ ID NO: 108250
  derived and/or modified sequence opt2 from neuraminidase__InfluenzaA__ADI48785

SEQ ID NO: 110412 - RNA, 1410 nt, Artificial Sequence; identical to SEQ ID NO: 108250
  derived and/or modified sequence opt2 from neuraminidase__InfluenzaA__ADI48795

SEQ ID NO: 110413 - RNA, 1410 nt, Artificial Sequence; identical to SEQ ID NO: 108250
  derived and/or modified sequence opt2 from neuraminidase__InfluenzaA__ADI49032

SEQ ID NO: 110414 - RNA, 1410 nt, Artificial Sequence; identical to SEQ ID NO: 108250
  derived and/or modified sequence opt2 from neuraminidase__InfluenzaA__ADI49243

SEQ ID NO: 110415 - RNA, 1410 nt, Artificial Sequence; identical to SEQ ID NO: 108250
  derived and/or modified sequence opt2 from neuraminidase__InfluenzaA__ADI49263

SEQ ID NO: 110416 - RNA, 1410 nt, Artificial Sequence; identical to SEQ ID NO: 108250
  derived and/or modified sequence opt2 from neuraminidase__InfluenzaA__ADI49273

SEQ ID NO: 110417 - RNA, 1410 nt, Artificial Sequence; identical to SEQ ID NO: 108250
  derived and/or modified sequence opt2 from neuraminidase__InfluenzaA__ADI49283

SEQ ID NO: 110418 - RNA, 1410 nt, Artificial Sequence; identical to SEQ ID NO: 108250
  derived and/or modified sequence opt2 from neuraminidase__InfluenzaA__ADI49315

SEQ ID NO: 110419 - RNA, 1410 nt, Artificial Sequence; identical to SEQ ID NO: 108250
  derived and/or modified sequence opt2 from neuraminidase__InfluenzaA__ADI49325

SEQ ID NO: 110420 - RNA, 1410 nt, Artificial Sequence; identical to SEQ ID NO: 108250
  derived and/or modified sequence opt2 from neuraminidase__InfluenzaA__ADI49335

SEQ ID NO: 110421 - RNA, 1410 nt, Artificial Sequence
  derived and/or modified sequence opt2 from neuraminidase__InfluenzaA__ADI49345
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaaccucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgacguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110422 - RNA, 1410 nt, Artificial Sequence; identical to SEQ ID NO: 108250
  derived and/or modified sequence opt2 from neuraminidase__InfluenzaA__ADI49355

SEQ ID NO: 110423 - RNA, 1410 nt, Artificial Sequence; identical to SEQ ID NO: 108250
  derived and/or modified sequence opt2 from neuraminidase__InfluenzaA__ADI49365

SEQ ID NO: 110424 - RNA, 1410 nt, Artificial Sequence; identical to SEQ ID NO: 108250
  derived and/or modified sequence opt2 from neuraminidase__InfluenzaA__ADI49375

SEQ ID NO: 110425 - RNA, 1410 nt, Artificial Sequence; identical to SEQ ID NO: 108250
  derived and/or modified sequence opt2 from neuraminidase__InfluenzaA__ADI49385

SEQ ID NO: 110426 - RNA, 1410 nt, Artificial Sequence
  derived and/or modified sequence opt2 from neuraminidase__InfluenzaA__ADI49395
augaaccccaaccagaagaucaucaccaucggcuccgucugcaugaccaucggcauggccaaccucauccuccagaucggcaacaugaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagcucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110427 - RNA, 1410 nt, Artificial Sequence; identical to SEQ ID NO: 108250
  derived and/or modified sequence opt2 from neuraminidase__InfluenzaA__ADI49720

SEQ ID NO: 110428 - RNA, 1410 nt, Artificial Sequence; identical to SEQ ID NO: 108250
  derived and/or modified sequence opt2 from neuraminidase__InfluenzaA__ADI49730

SEQ ID NO: 110429 - RNA, 1410 nt, Artificial Sequence; identical to SEQ ID NO: 108250
  derived and/or modified sequence opt2 from neuraminidase__InfluenzaA__ADI49740

SEQ ID NO: 110430 - RNA, 1410 nt, Artificial Sequence; identical to SEQ ID NO: 108250
  derived and/or modified sequence opt2 from neuraminidase__InfluenzaA__ADI49750

SEQ ID NO: 110431 - RNA, 1410 nt, Artificial Sequence; identical to SEQ ID NO: 108250
  derived and/or modified sequence opt2 from neuraminidase__InfluenzaA__ADI49760

SEQ ID NO: 110432 - RNA, 1410 nt, Artificial Sequence; identical to SEQ ID NO: 108280
  derived and/or modified sequence opt2 from neuraminidase__InfluenzaA__ADI49780

SEQ ID NO: 110433 - RNA, 1410 nt, Artificial Sequence; identical to SEQ ID NO: 108240
  derived and/or modified sequence opt2 from neuraminidase__InfluenzaA__ADI49790

SEQ ID NO: 110434 - RNA, 1410 nt, Artificial Sequence; identical to SEQ ID NO: 108250
  derived and/or modified sequence opt2 from neuraminidase__InfluenzaA__ADI49821

SEQ ID NO: 110435 - RNA, 1410 nt, Artificial Sequence; identical to SEQ ID NO: 108240
  derived and/or modified sequence opt2 from neuraminidase__InfluenzaA__ADI50029

SEQ ID NO: 110436 - RNA, 1410 nt, Artificial Sequence
  derived and/or modified sequence opt2 from neuraminidase__InfluenzaA__ADI52830
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgacgagcuccccuucaccaucgacaaguga

SEQ ID NO: 110437 - RNA, 1410 nt, Artificial Sequence
  derived and/or modified sequence opt2 from neuraminidase__InfluenzaA__ADI52831
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccgucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110438 - RNA, 1410 nt, Artificial Sequence; identical to SEQ ID NO: 108250
  derived and/or modified sequence opt2 from neuraminidase__InfluenzaA__ADI52832

SEQ ID NO: 110439 - RNA, 1410 nt, Artificial Sequence
  derived and/or modified sequence opt2 from neuraminidase__InfluenzaA__ADI52833
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgaggcccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110440 - RNA, 1413 nt, Artificial Sequence; identical to SEQ ID NO: 108973
  derived and/or modified sequence opt2 from neuraminidase__InfluenzaA__ADI75821

SEQ ID NO: 110441 - RNA, 1410 nt, Artificial Sequence; identical to SEQ ID NO: 109417
  derived and/or modified sequence opt2 from neuraminidase__InfluenzaA__ADI75832

SEQ ID NO: 110442 - RNA, 1413 nt, Artificial Sequence
  derived and/or modified sequence opt2 from neuraminidase__InfluenzaA__ADI75854
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110443 - RNA, 1410 nt, Artificial Sequence
  derived and/or modified sequence opt2 from neuraminidase__InfluenzaA__ADI75876
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccgucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110444 - RNA, 1410 nt, Artificial Sequence; identical to SEQ ID NO: 109417
  derived and/or modified sequence opt2 from neuraminidase__InfluenzaA__ADI75887

SEQ ID NO: 110445 - RNA, 1413 nt, Artificial Sequence; identical to SEQ ID NO: 108973
  derived and/or modified sequence opt2 from neuraminidase__InfluenzaA__ADI75909

SEQ ID NO: 110446 - RNA, 1410 nt, Artificial Sequence; identical to SEQ ID NO: 109996
  derived and/or modified sequence opt2 from neuraminidase__InfluenzaA__ADI75920

SEQ ID NO: 110447 - RNA, 1413 nt, Artificial Sequence; identical to SEQ ID NO: 108973
  derived and/or modified sequence opt2 from neuraminidase__InfluenzaA__ADI77352

SEQ ID NO: 110448 - RNA, 1410 nt, Artificial Sequence; identical to SEQ ID NO: 108250
  derived and/or modified sequence opt2 from neuraminidase__InfluenzaA__ADI77363

SEQ ID NO: 110449 - RNA, 1410 nt, Artificial Sequence; identical to SEQ ID NO: 109427
  derived and/or modified sequence opt2 from neuraminidase__InfluenzaA__ADI99500

SEQ ID NO: 110450 - RNA, 1410 nt, Artificial Sequence
  derived and/or modified sequence opt2 from neuraminidase__InfluenzaA__ADI99553
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgacuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110451 - RNA, 1410 nt, Artificial Sequence
  derived and/or modified sequence opt2 from neuraminidase__InfluenzaA__ADI99563
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgaggucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110452 - RNA, 1410 nt, Artificial Sequence; identical to SEQ ID NO: 110451
  derived and/or modified sequence opt2 from neuraminidase__InfluenzaA__ADI99573

SEQ ID NO: 110453 - RNA, 1410 nt, Artificial Sequence; identical to SEQ ID NO: 110451
  derived and/or modified sequence opt2 from neuraminidase__InfluenzaA__ADI99583

SEQ ID NO: 110454 - RNA, 1410 nt, Artificial Sequence; identical to SEQ ID NO: 109601
  derived and/or modified sequence opt2 from neuraminidase__InfluenzaA__ADI99593

SEQ ID NO: 110455 - RNA, 1410 nt, Artificial Sequence
  derived and/or modified sequence opt2 from neuraminidase__InfluenzaA__ADI99613
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 110456 - RNA, 1410 nt, Artificial Sequence
  derived and/or modified sequence opt2 from neuraminidase__InfluenzaA__ADI99623
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccaacgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110457 - RNA, 1410 nt, Artificial Sequence; identical to SEQ ID NO: 109538
  derived and/or modified sequence opt2 from neuraminidase__InfluenzaA__ADI99633

SEQ ID NO: 110458 - RNA, 1410 nt, Artificial Sequence; identical to SEQ ID NO: 109601
  derived and/or modified sequence opt2 from neuraminidase__InfluenzaA__ADI99643

SEQ ID NO: 110459 - RNA, 1410 nt, Artificial Sequence; identical to SEQ ID NO: 108250
  derived and/or modified sequence opt2 from neuraminidase__InfluenzaA__ADI99653

SEQ ID NO: 110460 - RNA, 1410 nt, Artificial Sequence; identical to SEQ ID NO: 108250
  derived and/or modified sequence opt2 from neuraminidase__InfluenzaA__ADI99663

SEQ ID NO: 110461 - RNA, 1410 nt, Artificial Sequence; identical to SEQ ID NO: 108250
  derived and/or modified sequence opt2 from neuraminidase__InfluenzaA__ADI99673

SEQ ID NO: 110462 - RNA, 1410 nt, Artificial Sequence; identical to SEQ ID NO: 108250
  derived and/or modified sequence opt2 from neuraminidase__InfluenzaA__ADI99683

SEQ ID NO: 110463 - RNA, 1410 nt, Artificial Sequence; identical to SEQ ID NO: 109712
  derived and/or modified sequence opt2 from neuraminidase__InfluenzaA__ADI99703

SEQ ID NO: 110464 - RNA, 1410 nt, Artificial Sequence; identical to SEQ ID NO: 108250
  derived and/or modified sequence opt2 from neuraminidase__InfluenzaA__ADI99713

SEQ ID NO: 110465 - RNA, 1410 nt, Artificial Sequence; identical to SEQ ID NO: 108250
  derived and/or modified sequence opt2 from neuraminidase__InfluenzaA__ADI99723

SEQ ID NO: 110466 - RNA, 1410 nt, Artificial Sequence; identical to SEQ ID NO: 108250
  derived and/or modified sequence opt2 from neuraminidase__InfluenzaA__ADI99733

SEQ ID NO: 110467 - RNA, 1410 nt, Artificial Sequence; identical to SEQ ID NO: 108405
  derived and/or modified sequence opt2 from neuraminidase__InfluenzaA__ADJ00487

SEQ ID NO: 110468 - RNA, 1410 nt, Artificial Sequence; identical to SEQ ID NO: 108405
  derived and/or modified sequence opt2 from neuraminidase__InfluenzaA__ADJ00488

SEQ ID NO: 110469 - RNA, 1410 nt, Artificial Sequence; identical to SEQ ID NO: 108405
  derived and/or modified sequence opt2 from neuraminidase__InfluenzaA__ADJ00489

SEQ ID NO: 110470 - RNA, 1410 nt, Artificial Sequence; identical to SEQ ID NO: 108405
  derived and/or modified sequence opt2 from neuraminidase__InfluenzaA__ADJ00490

SEQ ID NO: 110471 - RNA, 1410 nt, Artificial Sequence; identical to SEQ ID NO: 108405
  derived and/or modified sequence opt2 from neuraminidase__InfluenzaA__ADJ00491

SEQ ID NO: 110472 - RNA, 1410 nt, Artificial Sequence; identical to SEQ ID NO: 108250
  derived and/or modified sequence opt2 from neuraminidase__InfluenzaA__ADJ18160

SEQ ID NO: 110473 - RNA, 1410 nt, Artificial Sequence; identical to SEQ ID NO: 108250
  derived and/or modified sequence opt2 from neuraminidase__InfluenzaA__ADJ18161

SEQ ID NO: 110474 - RNA, 1410 nt, Artificial Sequence
  derived and/or modified sequence opt2 from neuraminidase__InfluenzaA__ADJ18162
augauccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcaagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110475 - RNA, 1410 nt, Artificial Sequence
  derived and/or modified sequence opt2 from neuraminidase__InfluenzaA__ADJ18164
augaaccccaagcagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugcuccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110476 - RNA, 1410 nt, Artificial Sequence; identical to SEQ ID NO: 108250
  derived and/or modified sequence opt2 from neuraminidase__InfluenzaA__ADJ18166

SEQ ID NO: 110477 - RNA, 1410 nt, Artificial Sequence; identical to SEQ ID NO: 108250
  derived and/or modified sequence opt2 from neuraminidase__InfluenzaA__ADJ18168

SEQ ID NO: 110478 - RNA, 1410 nt, Artificial Sequence; identical to SEQ ID NO: 108250
  derived and/or modified sequence opt2 from neuraminidase__InfluenzaA__ADJ18170

SEQ ID NO: 110479 - RNA, 1410 nt, Artificial Sequence
  derived and/or modified sequence opt2 from neuraminidase__InfluenzaA__ADJ18172
augaaccccaaccagaagaucaucaccaucggcuccgucugcaugaccaucggcauggccaaccucauccuccgcaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuaccgcaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110480 - RNA, 1410 nt, Artificial Sequence; identical to SEQ ID NO: 108250
  derived and/or modified sequence opt2 from neuraminidase__InfluenzaA__ADJ18174

SEQ ID NO: 110481 - RNA, 1410 nt, Artificial Sequence
  derived and/or modified sequence opt2 from neuraminidase__InfluenzaA__ADJ18176
augaaccccaaccagaagaucaucaccaucggcuccgucugcaugaccaucggcauggccaaccucauccuccagaucggcaacaucaucuccaucuggaucucccucuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110482 - RNA, 1410 nt, Artificial Sequence; identical to SEQ ID NO: 108023
  derived and/or modified sequence opt2 from neuraminidase__InfluenzaA__ADJ37250

SEQ ID NO: 110483 - RNA, 1410 nt, Artificial Sequence
  derived and/or modified sequence opt2 from neuraminidase__InfluenzaA__ADJ37252
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110484 - RNA, 1410 nt, Artificial Sequence; identical to SEQ ID NO: 108250
  derived and/or modified sequence opt2 from neuraminidase__InfluenzaA__ADJ37263

SEQ ID NO: 110485 - RNA, 1410 nt, Artificial Sequence; identical to SEQ ID NO: 108240
  derived and/or modified sequence opt2 from neuraminidase__InfluenzaA__ADJ37273

SEQ ID NO: 110486 - RNA, 1410 nt, Artificial Sequence; identical to SEQ ID NO: 108250
  derived and/or modified sequence opt2 from neuraminidase__InfluenzaA__ADJ40447

SEQ ID NO: 110487 - RNA, 1410 nt, Artificial Sequence; identical to SEQ ID NO: 108250
  derived and/or modified sequence opt2 from neuraminidase__InfluenzaA__ADJ40457

SEQ ID NO: 110488 - RNA, 1410 nt, Artificial Sequence; identical to SEQ ID NO: 109601
  derived and/or modified sequence opt2 from neuraminidase__InfluenzaA__ADJ40467

SEQ ID NO: 110489 - RNA, 1410 nt, Artificial Sequence
  derived and/or modified sequence opt2 from neuraminidase__InfluenzaA__ADJ40477
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccaugggcugguccuggcccgacggcgccgagcuccccuucaccaucgacaaguga

SEQ ID NO: 110490 - RNA, 1410 nt, Artificial Sequence; identical to SEQ ID NO: 108250
  derived and/or modified sequence opt2 from neuraminidase__InfluenzaA__ADJ40487

SEQ ID NO: 110491 - RNA, 1410 nt, Artificial Sequence; identical to SEQ ID NO: 108250
  derived and/or modified sequence opt2 from neuraminidase__InfluenzaA__ADJ40507

SEQ ID NO: 110492 - RNA, 1410 nt, Artificial Sequence; identical to SEQ ID NO: 108250
  derived and/or modified sequence opt2 from neuraminidase__InfluenzaA__ADJ40517

SEQ ID NO: 110493 - RNA, 1410 nt, Artificial Sequence; identical to SEQ ID NO: 108250
  derived and/or modified sequence opt2 from neuraminidase__InfluenzaA__ADJ40527

SEQ ID NO: 110494 - RNA, 1410 nt, Artificial Sequence
  derived and/or modified sequence opt2 from neuraminidase__InfluenzaA__ADJ40537
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccggcgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110495 - RNA, 1410 nt, Artificial Sequence
  derived and/or modified sequence opt2 from neuraminidase__InfluenzaA__ADJ40547
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110496 - RNA, 1410 nt, Artificial Sequence; identical to SEQ ID NO: 108250
  derived and/or modified sequence opt2 from neuraminidase__InfluenzaA__ADJ40557

SEQ ID NO: 110497 - RNA, 1410 nt, Artificial Sequence; identical to SEQ ID NO: 108250
  derived and/or modified sequence opt2 from neuraminidase__InfluenzaA__ADJ40577

SEQ ID NO: 110498 - RNA, 1410 nt, Artificial Sequence; identical to SEQ ID NO: 108250
  derived and/or modified sequence opt2 from neuraminidase__InfluenzaA__ADJ40587

SEQ ID NO: 110499 - RNA, 1410 nt, Artificial Sequence
  derived and/or modified sequence opt2 from neuraminidase__InfluenzaA__ADJ40597
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuuccucaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110500 - RNA, 1410 nt, Artificial Sequence; identical to SEQ ID NO: 108250
  derived and/or modified sequence opt2 from neuraminidase__InfluenzaA__ADJ40607

SEQ ID NO: 110501 - RNA, 1410 nt, Artificial Sequence; identical to SEQ ID NO: 108250
  derived and/or modified sequence opt2 from neuraminidase__InfluenzaA__ADJ40617

SEQ ID NO: 110502 - RNA, 1410 nt, Artificial Sequence; identical to SEQ ID NO: 108604
  derived and/or modified sequence opt2 from neuraminidase__InfluenzaA__ADJ40627

SEQ ID NO: 110503 - RNA, 1410 nt, Artificial Sequence; identical to SEQ ID NO: 108250
  derived and/or modified sequence opt2 from neuraminidase__InfluenzaA__ADJ40637

SEQ ID NO: 110504 - RNA, 1410 nt, Artificial Sequence; identical to SEQ ID NO: 108250
  derived and/or modified sequence opt2 from neuraminidase__InfluenzaA__ADJ40657

SEQ ID NO: 110505 - RNA, 1410 nt, Artificial Sequence; identical to SEQ ID NO: 108250
  derived and/or modified sequence opt2 from neuraminidase__InfluenzaA__ADJ40667

SEQ ID NO: 110506 - RNA, 1410 nt, Artificial Sequence; identical to SEQ ID NO: 108250
  derived and/or modified sequence opt2 from neuraminidase__InfluenzaA__ADJ40677

SEQ ID NO: 110507 - RNA, 1410 nt, Artificial Sequence
  derived and/or modified sequence opt2 from neuraminidase__InfluenzaA__ADJ41819
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucguccccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcaucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 110508 - RNA, 1410 nt, Artificial Sequence; identical to SEQ ID NO: 108250
  derived and/or modified sequence opt2 from neuraminidase__InfluenzaA__ADJ56642

SEQ ID NO: 110509 - RNA, 1410 nt, Artificial Sequence; identical to SEQ ID NO: 108250
  derived and/or modified sequence opt2 from neuraminidase__InfluenzaA__ADJ56652

SEQ ID NO: 110510 - RNA, 1410 nt, Artificial Sequence; identical to SEQ ID NO: 108250
  derived and/or modified sequence opt2 from neuraminidase__InfluenzaA__ADJ80637

SEQ ID NO: 110511 - RNA, 1410 nt, Artificial Sequence; identical to SEQ ID NO: 109268
  derived and/or modified sequence opt2 from neuraminidase__InfluenzaA__ADJ80647

SEQ ID NO: 110512 - RNA, 1410 nt, Artificial Sequence; identical to SEQ ID NO: 109268
  derived and/or modified sequence opt2 from neuraminidase__InfluenzaA__ADJ80657

SEQ ID NO: 110513 - RNA, 1410 nt, Artificial Sequence; identical to SEQ ID NO: 108250
  derived and/or modified sequence opt2 from neuraminidase__InfluenzaA__ADJ80667

SEQ ID NO: 110514 - RNA, 1410 nt, Artificial Sequence; identical to SEQ ID NO: 110163
  derived and/or modified sequence opt2 from neuraminidase__InfluenzaA__ADJ80677

SEQ ID NO: 110515 - RNA, 1410 nt, Artificial Sequence; identical to SEQ ID NO: 109538
  derived and/or modified sequence opt2 from neuraminidase__InfluenzaA__ADJ80687

SEQ ID NO: 110516 - RNA, 1410 nt, Artificial Sequence
  derived and/or modified sequence opt2 from neuraminidase__InfluenzaA__ADJ80697
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucaucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110517 - RNA, 1410 nt, Artificial Sequence
  derived and/or modified sequence opt2 from neuraminidase__InfluenzaA__ADJ80717
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccgucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110518 - RNA, 1410 nt, Artificial Sequence
  derived and/or modified sequence opt2 from neuraminidase__InfluenzaA__ADJ80727
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggucaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110519 - RNA, 1410 nt, Artificial Sequence; identical to SEQ ID NO: 109017
  derived and/or modified sequence opt2 from neuraminidase__InfluenzaA__ADJ80737

SEQ ID NO: 110520 - RNA, 1410 nt, Artificial Sequence
  derived and/or modified sequence opt2 from neuraminidase__InfluenzaA__ADJ80747
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcuccuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagcgcggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucgagaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110521 - RNA, 1410 nt, Artificial Sequence; identical to SEQ ID NO: 108250
  derived and/or modified sequence opt2 from neuraminidase__InfluenzaA__ADJ80757

SEQ ID NO: 110522 - RNA, 1410 nt, Artificial Sequence; identical to SEQ ID NO: 108250
  derived and/or modified sequence opt2 from neuraminidase__InfluenzaA__ADJ80767

SEQ ID NO: 110523 - RNA, 1410 nt, Artificial Sequence; identical to SEQ ID NO: 108833
  derived and/or modified sequence opt2 from neuraminidase__InfluenzaA__ADJ80777

SEQ ID NO: 110524 - RNA, 1410 nt, Artificial Sequence; identical to SEQ ID NO: 108250
  derived and/or modified sequence opt2 from neuraminidase__InfluenzaA__ADJ80787

SEQ ID NO: 110525 - RNA, 1410 nt, Artificial Sequence
  derived and/or modified sequence opt2 from neuraminidase__InfluenzaA__ADJ80797
augaaccccaaccagaagaucaucaccaucggcuccgucugcaugaccaucggcauggccaaccucauccuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110526 - RNA, 1410 nt, Artificial Sequence; identical to SEQ ID NO: 109268
  derived and/or modified sequence opt2 from neuraminidase__InfluenzaA__ADJ80807

SEQ ID NO: 110527 - RNA, 1410 nt, Artificial Sequence; identical to SEQ ID NO: 108250
  derived and/or modified sequence opt2 from neuraminidase__InfluenzaA__ADJ80817

SEQ ID NO: 110528 - RNA, 1410 nt, Artificial Sequence; identical to SEQ ID NO: 108250
  derived and/or modified sequence opt2 from neuraminidase__InfluenzaA__ADJ80827

SEQ ID NO: 110529 - RNA, 1410 nt, Artificial Sequence; identical to SEQ ID NO: 109763
  derived and/or modified sequence opt2 from neuraminidase__InfluenzaA__ADJ80837

SEQ ID NO: 110530 - RNA, 1410 nt, Artificial Sequence; identical to SEQ ID NO: 110261
  derived and/or modified sequence opt2 from neuraminidase__InfluenzaA__ADJ80851

SEQ ID NO: 110531 - RNA, 1410 nt, Artificial Sequence
  derived and/or modified sequence opt2 from neuraminidase__InfluenzaA__ADJ80861
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucucccccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110532 - RNA, 1410 nt, Artificial Sequence; identical to SEQ ID NO: 110525
  derived and/or modified sequence opt2 from neuraminidase__InfluenzaA__ADJ80871

SEQ ID NO: 110533 - RNA, 1410 nt, Artificial Sequence; identical to SEQ ID NO: 108250
  derived and/or modified sequence opt2 from neuraminidase__InfluenzaA__ADJ80886

SEQ ID NO: 110534 - RNA, 1410 nt, Artificial Sequence
  derived and/or modified sequence opt2 from neuraminidase__InfluenzaA__ADJ80896
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucaccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110535 - RNA, 1410 nt, Artificial Sequence
  derived and/or modified sequence opt2 from neuraminidase__InfluenzaA__ADJ80913
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcuccuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110536 - RNA, 1410 nt, Artificial Sequence; identical to SEQ ID NO: 108250
  derived and/or modified sequence opt2 from neuraminidase__InfluenzaA__ADJ80930

SEQ ID NO: 110537 - RNA, 1410 nt, Artificial Sequence; identical to SEQ ID NO: 108250
  derived and/or modified sequence opt2 from neuraminidase__InfluenzaA__ADJ80950

SEQ ID NO: 110538 - RNA, 1410 nt, Artificial Sequence; identical to SEQ ID NO: 109538
  derived and/or modified sequence opt2 from neuraminidase__InfluenzaA__ADJ80960

SEQ ID NO: 110539 - RNA, 1410 nt, Artificial Sequence; identical to SEQ ID NO: 110525
  derived and/or modified sequence opt2 from neuraminidase__InfluenzaA__ADJ80970

SEQ ID NO: 110540 - RNA, 1410 nt, Artificial Sequence; identical to SEQ ID NO: 108250
  derived and/or modified sequence opt2 from neuraminidase__InfluenzaA__ADJ80980

SEQ ID NO: 110541 - RNA, 1410 nt, Artificial Sequence; identical to SEQ ID NO: 110525
  derived and/or modified sequence opt2 from neuraminidase__InfluenzaA__ADJ80996

SEQ ID NO: 110542 - RNA, 1410 nt, Artificial Sequence
  derived and/or modified sequence opt2 from neuraminidase__InfluenzaA__ADJ81006
augaaccccaaccagaagaucaucaccaucggcuccgucugcaugaccaucggcauggccaaccucauccuccaggucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110543 - RNA, 1410 nt, Artificial Sequence; identical to SEQ ID NO: 110261
  derived and/or modified sequence opt2 from neuraminidase__InfluenzaA__ADJ81016

SEQ ID NO: 110544 - RNA, 1410 nt, Artificial Sequence; identical to SEQ ID NO: 110450
  derived and/or modified sequence opt2 from neuraminidase__InfluenzaA__ADJ81026

SEQ ID NO: 110545 - RNA, 1410 nt, Artificial Sequence; identical to SEQ ID NO: 108250
  derived and/or modified sequence opt2 from neuraminidase__InfluenzaA__ADJ81036

SEQ ID NO: 110546 - RNA, 1410 nt, Artificial Sequence
  derived and/or modified sequence opt2 from neuraminidase__InfluenzaA__ADJ81046
augaaccccaaccagaagaucaucaccaucggcuccgucugcaugaccgucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110547 - RNA, 1410 nt, Artificial Sequence
  derived and/or modified sequence opt2 from neuraminidase__InfluenzaA__ADJ81056
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucguccccgucaagcucgccggcuccuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110548 - RNA, 1410 nt, Artificial Sequence; identical to SEQ ID NO: 109538
  derived and/or modified sequence opt2 from neuraminidase__InfluenzaA__ADJ81066

SEQ ID NO: 110549 - RNA, 1410 nt, Artificial Sequence; identical to SEQ ID NO: 108111
  derived and/or modified sequence opt2 from neuraminidase__InfluenzaA__ADJ84775

SEQ ID NO: 110550 - RNA, 1410 nt, Artificial Sequence
  derived and/or modified sequence opt2 from neuraminidase__InfluenzaA__ADJ88785
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccgucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110551 - RNA, 1410 nt, Artificial Sequence; identical to SEQ ID NO: 108250
  derived and/or modified sequence opt2 from neuraminidase__InfluenzaA__ADK21716

SEQ ID NO: 110552 - RNA, 1410 nt, Artificial Sequence; identical to SEQ ID NO: 108250
  derived and/or modified sequence opt2 from neuraminidase__InfluenzaA__ADK21726

SEQ ID NO: 110553 - RNA, 1410 nt, Artificial Sequence; identical to SEQ ID NO: 108250
  derived and/or modified sequence opt2 from neuraminidase__InfluenzaA__ADK21736

SEQ ID NO: 110554 - RNA, 1410 nt, Artificial Sequence
  derived and/or modified sequence opt2 from neuraminidase__InfluenzaA__ADK21746
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagcacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccgaggagaacaccaucuggaccuccggcuccuccaucuccuucugcggcgucaacuccgacaccgucggcugguccuggcccgacggcgccgagcuccccuucaccaucgacaaguga

SEQ ID NO: 110555 - RNA, 1410 nt, Artificial Sequence; identical to SEQ ID NO: 108250
  derived and/or modified sequence opt2 from neuraminidase__InfluenzaA__ADK21756

SEQ ID NO: 110556 - RNA, 1410 nt, Artificial Sequence; identical to SEQ ID NO: 108250
  derived and/or modified sequence opt2 from neuraminidase__InfluenzaA__ADK21766

SEQ ID NO: 110557 - RNA, 1410 nt, Artificial Sequence; identical to SEQ ID NO: 109681
  derived and/or modified sequence opt2 from neuraminidase__InfluenzaA__ADK21776

SEQ ID NO: 110558 - RNA, 1410 nt, Artificial Sequence; identical to SEQ ID NO: 108250
  derived and/or modified sequence opt2 from neuraminidase__InfluenzaA__ADK21786

SEQ ID NO: 110559 - RNA, 1410 nt, Artificial Sequence; identical to SEQ ID NO: 108250
  derived and/or modified sequence opt2 from neuraminidase__InfluenzaA__ADK21796

SEQ ID NO: 110560 - RNA, 1410 nt, Artificial Sequence; identical to SEQ ID NO: 108250
  derived and/or modified sequence opt2 from neuraminidase__InfluenzaA__ADK21806

SEQ ID NO: 110561 - RNA, 1410 nt, Artificial Sequence; identical to SEQ ID NO: 108250
  derived and/or modified sequence opt2 from neuraminidase__InfluenzaA__ADK21816

SEQ ID NO: 110562 - RNA, 1410 nt, Artificial Sequence; identical to SEQ ID NO: 110228
  derived and/or modified sequence opt2 from neuraminidase__InfluenzaA__ADK21826

SEQ ID NO: 110563 - RNA, 1410 nt, Artificial Sequence; identical to SEQ ID NO: 110141
  derived and/or modified sequence opt2 from neuraminidase__InfluenzaA__ADK21836

SEQ ID NO: 110564 - RNA, 1410 nt, Artificial Sequence
  derived and/or modified sequence opt2 from neuraminidase__InfluenzaA__ADK21846
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaugaagcaggacaucgucggcaucaacgagugguccggcuacuccggcuccuucguccagcaccccgagcucaccggccucgacugcauccgccccugcuucugggucgagcucauccgcggccgccccaaggagaacaccaucugggccuccggcuccuccaucuccuucugcggcgucaacuccgacaccgucggcugguccuggcccgacggcgccgagcuccccuucaccaucgacaaguga

SEQ ID NO: 110565 - RNA, 1410 nt, Artificial Sequence; identical to SEQ ID NO: 108250
  derived and/or modified sequence opt2 from neuraminidase__InfluenzaA__ADK21856

SEQ ID NO: 110566 - RNA, 1410 nt, Artificial Sequence; identical to SEQ ID NO: 108250
  derived and/or modified sequence opt2 from neuraminidase__InfluenzaA__ADK21866

SEQ ID NO: 110567 - RNA, 1410 nt, Artificial Sequence; identical to SEQ ID NO: 108250
  derived and/or modified sequence opt2 from neuraminidase__InfluenzaA__ADK21876

SEQ ID NO: 110568 - RNA, 1410 nt, Artificial Sequence; identical to SEQ ID NO: 108250
  derived and/or modified sequence opt2 from neuraminidase__InfluenzaA__ADK21886

SEQ ID NO: 110569 - RNA, 1410 nt, Artificial Sequence
  derived and/or modified sequence opt2 from neuraminidase__InfluenzaA__ADK21896
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucuccuccgacaccgucggcugguccuggcccgacggcgccgagcuccccuucaccaucgacaaguga

SEQ ID NO: 110570 - RNA, 1410 nt, Artificial Sequence
  derived and/or modified sequence opt2 from neuraminidase__InfluenzaA__ADK21906
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccuggaucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucggcucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110571 - RNA, 1410 nt, Artificial Sequence; identical to SEQ ID NO: 108250
  derived and/or modified sequence opt2 from neuraminidase__InfluenzaA__ADK21916

SEQ ID NO: 110572 - RNA, 1410 nt, Artificial Sequence; identical to SEQ ID NO: 108250
  derived and/or modified sequence opt2 from neuraminidase__InfluenzaA__ADK21926

SEQ ID NO: 110573 - RNA, 1410 nt, Artificial Sequence; identical to SEQ ID NO: 108250
  derived and/or modified sequence opt2 from neuraminidase__InfluenzaA__ADK21936

SEQ ID NO: 110574 - RNA, 1410 nt, Artificial Sequence
  derived and/or modified sequence opt2 from neuraminidase__InfluenzaA__ADK21946
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110575 - RNA, 1410 nt, Artificial Sequence
  derived and/or modified sequence opt2 from neuraminidase__InfluenzaA__ADK21956
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccaacaccgucggcugguccuggcccgacggcgccgagcuccccuucaccaucgacaaguga

SEQ ID NO: 110576 - RNA, 1410 nt, Artificial Sequence; identical to SEQ ID NO: 108250
  derived and/or modified sequence opt2 from neuraminidase__InfluenzaA__ADK32393

SEQ ID NO: 110577 - RNA, 1410 nt, Artificial Sequence; identical to SEQ ID NO: 108250
  derived and/or modified sequence opt2 from neuraminidase__InfluenzaA__ADK32403

SEQ ID NO: 110578 - RNA, 1410 nt, Artificial Sequence; identical to SEQ ID NO: 108250
  derived and/or modified sequence opt2 from neuraminidase__InfluenzaA__ADK32413

SEQ ID NO: 110579 - RNA, 1410 nt, Artificial Sequence
  derived and/or modified sequence opt2 from neuraminidase__InfluenzaA__ADK32423
augaaccccaaccagaagaucaucaccaucggcuccgucugcaugaccaucggcaugaccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110580 - RNA, 1410 nt, Artificial Sequence; identical to SEQ ID NO: 108250
  derived and/or modified sequence opt2 from neuraminidase__InfluenzaA__ADK32433

SEQ ID NO: 110581 - RNA, 1410 nt, Artificial Sequence; identical to SEQ ID NO: 108250
  derived and/or modified sequence opt2 from neuraminidase__InfluenzaA__ADK32443

SEQ ID NO: 110582 - RNA, 1410 nt, Artificial Sequence
  derived and/or modified sequence opt2 from neuraminidase__InfluenzaA__ADK32453
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucuccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110583 - RNA, 1410 nt, Artificial Sequence
  derived and/or modified sequence opt2 from neuraminidase__InfluenzaA__ADK32463
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccucaucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110584 - RNA, 1410 nt, Artificial Sequence; identical to SEQ ID NO: 108250
  derived and/or modified sequence opt2 from neuraminidase__InfluenzaA__ADK32473

SEQ ID NO: 110585 - RNA, 1410 nt, Artificial Sequence; identical to SEQ ID NO: 108250
  derived and/or modified sequence opt2 from neuraminidase__InfluenzaA__ADK32483

SEQ ID NO: 110586 - RNA, 1410 nt, Artificial Sequence; identical to SEQ ID NO: 108250
  derived and/or modified sequence opt2 from neuraminidase__InfluenzaA__ADK32493

SEQ ID NO: 110587 - RNA, 1410 nt, Artificial Sequence; identical to SEQ ID NO: 110163
  derived and/or modified sequence opt2 from neuraminidase__InfluenzaA__ADK32505

SEQ ID NO: 110588 - RNA, 1410 nt, Artificial Sequence
  derived and/or modified sequence opt2 from neuraminidase__InfluenzaA__ADK32640
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110589 - RNA, 1410 nt, Artificial Sequence; identical to SEQ ID NO: 108250
  derived and/or modified sequence opt2 from neuraminidase__InfluenzaA__ADK32650

SEQ ID NO: 110590 - RNA, 1410 nt, Artificial Sequence; identical to SEQ ID NO: 108250
  derived and/or modified sequence opt2 from neuraminidase__InfluenzaA__ADK32660

SEQ ID NO: 110591 - RNA, 1410 nt, Artificial Sequence; identical to SEQ ID NO: 108250
  derived and/or modified sequence opt2 from neuraminidase__InfluenzaA__ADK32670

SEQ ID NO: 110592 - RNA, 1410 nt, Artificial Sequence
  derived and/or modified sequence opt2 from neuraminidase__InfluenzaA__ADK32680
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacaagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110593 - RNA, 1410 nt, Artificial Sequence; identical to SEQ ID NO: 108250
  derived and/or modified sequence opt2 from neuraminidase__InfluenzaA__ADK32690

SEQ ID NO: 110594 - RNA, 1410 nt, Artificial Sequence; identical to SEQ ID NO: 108250
  derived and/or modified sequence opt2 from neuraminidase__InfluenzaA__ADK32700

SEQ ID NO: 110595 - RNA, 1410 nt, Artificial Sequence; identical to SEQ ID NO: 108250
  derived and/or modified sequence opt2 from neuraminidase__InfluenzaA__ADK32779

SEQ ID NO: 110596 - RNA, 1410 nt, Artificial Sequence; identical to SEQ ID NO: 108250
  derived and/or modified sequence opt2 from neuraminidase__InfluenzaA__ADK33614

SEQ ID NO: 110597 - RNA, 1410 nt, Artificial Sequence; identical to SEQ ID NO: 108250
  derived and/or modified sequence opt2 from neuraminidase__InfluenzaA__ADK33624

SEQ ID NO: 110598 - RNA, 1410 nt, Artificial Sequence; identical to SEQ ID NO: 108250
  derived and/or modified sequence opt2 from neuraminidase__InfluenzaA__ADK33634

SEQ ID NO: 110599 - RNA, 1410 nt, Artificial Sequence
  derived and/or modified sequence opt2 from neuraminidase__InfluenzaA__ADK33644
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggcuccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110600 - RNA, 1410 nt, Artificial Sequence; identical to SEQ ID NO: 109981
  derived and/or modified sequence opt2 from neuraminidase__InfluenzaA__ADK33654

SEQ ID NO: 110601 - RNA, 1410 nt, Artificial Sequence; identical to SEQ ID NO: 109981
  derived and/or modified sequence opt2 from neuraminidase__InfluenzaA__ADK33664

SEQ ID NO: 110602 - RNA, 1410 nt, Artificial Sequence; identical to SEQ ID NO: 108250
  derived and/or modified sequence opt2 from neuraminidase__InfluenzaA__ADK33674

SEQ ID NO: 110603 - RNA, 1410 nt, Artificial Sequence; identical to SEQ ID NO: 108250
  derived and/or modified sequence opt2 from neuraminidase__InfluenzaA__ADK33684

SEQ ID NO: 110604 - RNA, 1410 nt, Artificial Sequence; identical to SEQ ID NO: 109601
  derived and/or modified sequence opt2 from neuraminidase__InfluenzaA__ADK33694

SEQ ID NO: 110605 - RNA, 1410 nt, Artificial Sequence; identical to SEQ ID NO: 108250
  derived and/or modified sequence opt2 from neuraminidase__InfluenzaA__ADK33704

SEQ ID NO: 110606 - RNA, 1410 nt, Artificial Sequence; identical to SEQ ID NO: 108250
  derived and/or modified sequence opt2 from neuraminidase__InfluenzaA__ADK33714

SEQ ID NO: 110607 - RNA, 1410 nt, Artificial Sequence; identical to SEQ ID NO: 108250
  derived and/or modified sequence opt2 from neuraminidase__InfluenzaA__ADK33744

SEQ ID NO: 110608 - RNA, 1410 nt, Artificial Sequence
  derived and/or modified sequence opt2 from neuraminidase__InfluenzaA__ADK33754
augaaccccaaccagaagaucaucaccaucggcuccgucugcaugaccaucggcauggccaacuucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110609 - RNA, 1410 nt, Artificial Sequence
  derived and/or modified sequence opt2 from neuraminidase__InfluenzaA__ADK33764
augaaccccaaccagaagaucaucaccaucggcuccgucugcaugaccaucggcauggccaacuucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110610 - RNA, 1410 nt, Artificial Sequence
  derived and/or modified sequence opt2 from neuraminidase__InfluenzaA__ADK33774
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110611 - RNA, 1410 nt, Artificial Sequence; identical to SEQ ID NO: 109224
  derived and/or modified sequence opt2 from neuraminidase__InfluenzaA__ADK33784

SEQ ID NO: 110612 - RNA, 1410 nt, Artificial Sequence; identical to SEQ ID NO: 108250
  derived and/or modified sequence opt2 from neuraminidase__InfluenzaA__ADK33794

SEQ ID NO: 110613 - RNA, 1410 nt, Artificial Sequence; identical to SEQ ID NO: 108250
  derived and/or modified sequence opt2 from neuraminidase__InfluenzaA__ADK33804

SEQ ID NO: 110614 - RNA, 1410 nt, Artificial Sequence
  derived and/or modified sequence opt2 from neuraminidase__InfluenzaA__ADK33814
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaacaagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110615 - RNA, 1410 nt, Artificial Sequence
  derived and/or modified sequence opt2 from neuraminidase__InfluenzaA__ADK33824
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacaucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110616 - RNA, 1410 nt, Artificial Sequence; identical to SEQ ID NO: 109427
  derived and/or modified sequence opt2 from neuraminidase__InfluenzaA__ADK33834

SEQ ID NO: 110617 - RNA, 1410 nt, Artificial Sequence
  derived and/or modified sequence opt2 from neuraminidase__InfluenzaA__ADK33844
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgccaagcucgccggcaacuccccccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110618 - RNA, 1410 nt, Artificial Sequence; identical to SEQ ID NO: 109427
  derived and/or modified sequence opt2 from neuraminidase__InfluenzaA__ADK33854

SEQ ID NO: 110619 - RNA, 1410 nt, Artificial Sequence; identical to SEQ ID NO: 110141
  derived and/or modified sequence opt2 from neuraminidase__InfluenzaA__ADK33864

SEQ ID NO: 110620 - RNA, 1410 nt, Artificial Sequence
  derived and/or modified sequence opt2 from neuraminidase__InfluenzaA__ADK33874
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuaccucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110621 - RNA, 1410 nt, Artificial Sequence; identical to SEQ ID NO: 108250
  derived and/or modified sequence opt2 from neuraminidase__InfluenzaA__ADK33884

SEQ ID NO: 110622 - RNA, 1410 nt, Artificial Sequence; identical to SEQ ID NO: 109427
  derived and/or modified sequence opt2 from neuraminidase__InfluenzaA__ADK33894

SEQ ID NO: 110623 - RNA, 1410 nt, Artificial Sequence; identical to SEQ ID NO: 109427
  derived and/or modified sequence opt2 from neuraminidase__InfluenzaA__ADK33904

SEQ ID NO: 110624 - RNA, 1410 nt, Artificial Sequence; identical to SEQ ID NO: 110207
  derived and/or modified sequence opt2 from neuraminidase__InfluenzaA__ADK33914

SEQ ID NO: 110625 - RNA, 1410 nt, Artificial Sequence
  derived and/or modified sequence opt2 from neuraminidase__InfluenzaA__ADK33924
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccaacaccgucggcugguccuggcccgacggcgccgagcuccccuucaccaucgacaaguga

SEQ ID NO: 110626 - RNA, 1410 nt, Artificial Sequence; identical to SEQ ID NO: 108250
  derived and/or modified sequence opt2 from neuraminidase__InfluenzaA__ADK33934

SEQ ID NO: 110627 - RNA, 1410 nt, Artificial Sequence; identical to SEQ ID NO: 108250
  derived and/or modified sequence opt2 from neuraminidase__InfluenzaA__ADK33944

SEQ ID NO: 110628 - RNA, 1410 nt, Artificial Sequence; identical to SEQ ID NO: 110207
  derived and/or modified sequence opt2 from neuraminidase__InfluenzaA__ADK33954

SEQ ID NO: 110629 - RNA, 1410 nt, Artificial Sequence; identical to SEQ ID NO: 108250
  derived and/or modified sequence opt2 from neuraminidase__InfluenzaA__ADK33964

SEQ ID NO: 110630 - RNA, 1410 nt, Artificial Sequence; identical to SEQ ID NO: 109357
  derived and/or modified sequence opt2 from neuraminidase__InfluenzaA__ADK33974

SEQ ID NO: 110631 - RNA, 1410 nt, Artificial Sequence; identical to SEQ ID NO: 108250
  derived and/or modified sequence opt2 from neuraminidase__InfluenzaA__ADK33984

SEQ ID NO: 110632 - RNA, 1410 nt, Artificial Sequence
  derived and/or modified sequence opt2 from neuraminidase__InfluenzaA__ADK39016
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccgacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110633 - RNA, 1410 nt, Artificial Sequence; identical to SEQ ID NO: 108111
  derived and/or modified sequence opt2 from neuraminidase__InfluenzaA__ADK45315

SEQ ID NO: 110634 - RNA, 1410 nt, Artificial Sequence
  derived and/or modified sequence opt2 from neuraminidase__InfluenzaA__ADK45413
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucuacgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110635 - RNA, 1410 nt, Artificial Sequence
  derived and/or modified sequence opt2 from neuraminidase__InfluenzaA__ADK45424
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110636 - RNA, 1410 nt, Artificial Sequence; identical to SEQ ID NO: 109417
  derived and/or modified sequence opt2 from neuraminidase__InfluenzaA__ADK45446

SEQ ID NO: 110637 - RNA, 1410 nt, Artificial Sequence
  derived and/or modified sequence opt2 from neuraminidase__InfluenzaA__ADK45457
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccggcuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110638 - RNA, 1410 nt, Artificial Sequence
  derived and/or modified sequence opt2 from neuraminidase__InfluenzaA__ADK45479
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaaggucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggaggccgagguccucuggaccuccaacuccaucgucgucuucugcggcaccuccggcaccuacggcaccggcuccuggcccgacggcgccgaccucaaccucaugcccaucuga

SEQ ID NO: 110639 - RNA, 1410 nt, Artificial Sequence; identical to SEQ ID NO: 108250
  derived and/or modified sequence opt2 from neuraminidase__InfluenzaA__ADK48799

SEQ ID NO: 110640 - RNA, 1410 nt, Artificial Sequence; identical to SEQ ID NO: 110163
  derived and/or modified sequence opt2 from neuraminidase__InfluenzaA__ADK62686

SEQ ID NO: 110641 - RNA, 1410 nt, Artificial Sequence; identical to SEQ ID NO: 109601
  derived and/or modified sequence opt2 from neuraminidase__InfluenzaA__ADK62696

SEQ ID NO: 110642 - RNA, 1410 nt, Artificial Sequence; identical to SEQ ID NO: 108833
  derived and/or modified sequence opt2 from neuraminidase__InfluenzaA__ADK64994

SEQ ID NO: 110643 - RNA, 1410 nt, Artificial Sequence
  derived and/or modified sequence opt2 from neuraminidase__InfluenzaA__ADK65002
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaccggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccggccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110644 - RNA, 1410 nt, Artificial Sequence; identical to SEQ ID NO: 108250
  derived and/or modified sequence opt2 from neuraminidase__InfluenzaA__ADK65010

SEQ ID NO: 110645 - RNA, 1410 nt, Artificial Sequence
  derived and/or modified sequence opt2 from neuraminidase__InfluenzaA__ADK65018
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccuggcccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccaucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110646 - RNA, 1410 nt, Artificial Sequence
  derived and/or modified sequence opt2 from neuraminidase__InfluenzaA__ADK87290
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccuacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 110647 - RNA, 1410 nt, Artificial Sequence
  derived and/or modified sequence opt2 from neuraminidase__InfluenzaA__ADK87292
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgccugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 110648 - RNA, 1410 nt, Artificial Sequence
  derived and/or modified sequence opt2 from neuraminidase__InfluenzaA__ADK87294
augaaccccaaccagaagaucaucgccaucggcuccgucucccucaccaucuccaccaucugcuucuuccuccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccgcgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaccggcaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacaacaucgucgucuucugcggcaccuccggcaccuacggcaccggcuccuggcccgacggcgccgacaucaaccucaugcccgucuga

SEQ ID NO: 110649 - RNA, 1410 nt, Artificial Sequence
  derived and/or modified sequence opt2 from neuraminidase__InfluenzaA__ADK87297
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaagaaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110650 - RNA, 1410 nt, Artificial Sequence
  derived and/or modified sequence opt2 from neuraminidase__InfluenzaA__ADK87299
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuucaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110651 - RNA, 1410 nt, Artificial Sequence
  derived and/or modified sequence opt2 from neuraminidase__InfluenzaA__ADK87301
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgccaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110652 - RNA, 1410 nt, Artificial Sequence; identical to SEQ ID NO: 108111
  derived and/or modified sequence opt2 from neuraminidase__InfluenzaA__ADK87303

SEQ ID NO: 110653 - RNA, 1410 nt, Artificial Sequence
  derived and/or modified sequence opt2 from neuraminidase__InfluenzaA__ADK87305
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucggccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 110654 - RNA, 1410 nt, Artificial Sequence
  derived and/or modified sequence opt2 from neuraminidase__InfluenzaA__ADK87307
augaaccccaaccagaaggucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucggccgcggcaaccgcuccggcuacuccggcaucuucuccgucgagggcaaguccugcaucaaccgcugcuucuacgucgagcucaucggcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 110655 - RNA, 1410 nt, Artificial Sequence
  derived and/or modified sequence opt2 from neuraminidase__InfluenzaA__ADK87312
augaaccccaaccagaccaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucaucuccgucaagcucgccggcaacuccucccucugccccgucuccggcugggccaucuacuccaaggacaacaacauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110656 - RNA, 1410 nt, Artificial Sequence
  derived and/or modified sequence opt2 from neuraminidase__InfluenzaA__ADK87314
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagggcaacaucaccgagaucgucuaccucaccaacaccaccaucgagaaggagaugugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccaccuccuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 110657 - RNA, 1410 nt, Artificial Sequence
  derived and/or modified sequence opt2 from neuraminidase__InfluenzaA__ADK87316
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagaucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110658 - RNA, 1410 nt, Artificial Sequence
  derived and/or modified sequence opt2 from neuraminidase__InfluenzaA__ADK87318
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuccugggucgagcucauccgcggccgccccaaggagaacaccaucuggaccuccggcuccuccaccuccuucugcggcgucaacuccgacaccgucggcugguccuggcccgacggcgccgagcuccccuucaccaucgacaaguga

SEQ ID NO: 110659 - RNA, 1410 nt, Artificial Sequence
  derived and/or modified sequence opt2 from neuraminidase__InfluenzaA__ADK87320
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccuggguccaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110660 - RNA, 1410 nt, Artificial Sequence
  derived and/or modified sequence opt2 from neuraminidase__InfluenzaA__ADK87324
augaaccccaaccagaagaucaucaccaucggcuccgucucccucaccaucuccaccaucugcuuccucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacgagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 110661 - RNA, 1410 nt, Artificial Sequence
  derived and/or modified sequence opt2 from neuraminidase__InfluenzaA__ADK87327
augaaccccaaccagaagaucaugaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagcgcucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 110662 - RNA, 1410 nt, Artificial Sequence; identical to SEQ ID NO: 108250
  derived and/or modified sequence opt2 from neuraminidase__InfluenzaA__ADK87329

SEQ ID NO: 110663 - RNA, 1410 nt, Artificial Sequence
  derived and/or modified sequence opt2 from neuraminidase__InfluenzaA__ADK87330
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucugggccuccggcuccuccaucuccuucugcggcgucaacuccgacaccgucggcugguccuggcccgacggcgccgagcuccccuucaccaucgacaaguga

SEQ ID NO: 110664 - RNA, 1410 nt, Artificial Sequence; identical to SEQ ID NO: 108250
  derived and/or modified sequence opt2 from neuraminidase__InfluenzaA__ADK87331

SEQ ID NO: 110665 - RNA, 1410 nt, Artificial Sequence
  derived and/or modified sequence opt2 from neuraminidase__InfluenzaA__ADK87332
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaagcacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110666 - RNA, 1410 nt, Artificial Sequence
  derived and/or modified sequence opt2 from neuraminidase__InfluenzaA__ADK87333
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccuacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110667 - RNA, 1410 nt, Artificial Sequence
  derived and/or modified sequence opt2 from neuraminidase__InfluenzaA__ADK87335
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgaccgccgcuaccaguucgcccucggccagggcaccacccucaacaacguccacuccgacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110668 - RNA, 1410 nt, Artificial Sequence
  derived and/or modified sequence opt2 from neuraminidase__InfluenzaA__ADK87337
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacgccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110669 - RNA, 1410 nt, Artificial Sequence
  derived and/or modified sequence opt2 from neuraminidase__InfluenzaA__ADK87339
augaaccccaaccagaagaucaucaccaucggcuccaucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110670 - RNA, 1410 nt, Artificial Sequence; identical to SEQ ID NO: 108250
  derived and/or modified sequence opt2 from neuraminidase__InfluenzaA__ADK90209

SEQ ID NO: 110671 - RNA, 1410 nt, Artificial Sequence; identical to SEQ ID NO: 108250
  derived and/or modified sequence opt2 from neuraminidase__InfluenzaA__ADK90213

SEQ ID NO: 110672 - RNA, 1410 nt, Artificial Sequence; identical to SEQ ID NO: 108250
  derived and/or modified sequence opt2 from neuraminidase__InfluenzaA__ADK90217

SEQ ID NO: 110673 - RNA, 1410 nt, Artificial Sequence; identical to SEQ ID NO: 110229
  derived and/or modified sequence opt2 from neuraminidase__InfluenzaA__ADK90221

SEQ ID NO: 110674 - RNA, 1410 nt, Artificial Sequence; identical to SEQ ID NO: 110229
  derived and/or modified sequence opt2 from neuraminidase__InfluenzaA__ADK90225

SEQ ID NO: 110675 - RNA, 1410 nt, Artificial Sequence; identical to SEQ ID NO: 108250
  derived and/or modified sequence opt2 from neuraminidase__InfluenzaA__ADK90229

SEQ ID NO: 110676 - RNA, 1410 nt, Artificial Sequence; identical to SEQ ID NO: 108250
  derived and/or modified sequence opt2 from neuraminidase__InfluenzaA__ADK90233

SEQ ID NO: 110677 - RNA, 1410 nt, Artificial Sequence
  derived and/or modified sequence opt2 from neuraminidase__InfluenzaA__ADK90241
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacgccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110678 - RNA, 1410 nt, Artificial Sequence; identical to SEQ ID NO: 110229
  derived and/or modified sequence opt2 from neuraminidase__InfluenzaA__ADK90245

SEQ ID NO: 110679 - RNA, 1410 nt, Artificial Sequence
  derived and/or modified sequence opt2 from neuraminidase__InfluenzaA__ADK90249
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaugaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110680 - RNA, 1410 nt, Artificial Sequence; identical to SEQ ID NO: 110679
  derived and/or modified sequence opt2 from neuraminidase__InfluenzaA__ADK90253

SEQ ID NO: 110681 - RNA, 1410 nt, Artificial Sequence
  derived and/or modified sequence opt2 from neuraminidase__InfluenzaA__ADK90257
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110682 - RNA, 1410 nt, Artificial Sequence; identical to SEQ ID NO: 108604
  derived and/or modified sequence opt2 from neuraminidase__InfluenzaA__ADK90261

SEQ ID NO: 110683 - RNA, 1410 nt, Artificial Sequence
  derived and/or modified sequence opt2 from neuraminidase__InfluenzaA__ADK90265
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110684 - RNA, 1410 nt, Artificial Sequence
  derived and/or modified sequence opt2 from neuraminidase__InfluenzaA__ADK90269
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaagugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccaucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 110685 - RNA, 1410 nt, Artificial Sequence; identical to SEQ ID NO: 108250
  derived and/or modified sequence opt2 from neuraminidase__InfluenzaA__ADK90273

SEQ ID NO: 110686 - RNA, 1410 nt, Artificial Sequence; identical to SEQ ID NO: 108250
  derived and/or modified sequence opt2 from neuraminidase__InfluenzaA__ADK90277

SEQ ID NO: 110687 - RNA, 1410 nt, Artificial Sequence; identical to SEQ ID NO: 108250
  derived and/or modified sequence opt2 from neuraminidase__InfluenzaA__ADK90281

SEQ ID NO: 110688 - RNA, 1410 nt, Artificial Sequence
  derived and/or modified sequence opt2 from neuraminidase__InfluenzaA__ADK90289
augaaccccaaccagaagaucaucaccaucggcuccgucugcaugaccaucggcauggccaaccucauccuccagaucggcaacaucaucuccaucuggaucucccacuccauccagcucggcaaccagaaccucaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110689 - RNA, 1410 nt, Artificial Sequence; identical to SEQ ID NO: 110229
  derived and/or modified sequence opt2 from neuraminidase__InfluenzaA__ADK90293

SEQ ID NO: 110690 - RNA, 1410 nt, Artificial Sequence; identical to SEQ ID NO: 110141
  derived and/or modified sequence opt2 from neuraminidase__InfluenzaA__ADK90297

SEQ ID NO: 110691 - RNA, 1410 nt, Artificial Sequence; identical to SEQ ID NO: 108250
  derived and/or modified sequence opt2 from neuraminidase__InfluenzaA__ADK90301

SEQ ID NO: 110692 - RNA, 1410 nt, Artificial Sequence; identical to SEQ ID NO: 110141
  derived and/or modified sequence opt2 from neuraminidase__InfluenzaA__ADK90305

SEQ ID NO: 110693 - RNA, 1410 nt, Artificial Sequence; identical to SEQ ID NO: 108250
  derived and/or modified sequence opt2 from neuraminidase__InfluenzaA__ADK90309

SEQ ID NO: 110694 - RNA, 1410 nt, Artificial Sequence
  derived and/or modified sequence opt2 from neuraminidase__InfluenzaA__ADK90313
augaaccccaaccacaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110695 - RNA, 1410 nt, Artificial Sequence; identical to SEQ ID NO: 108250
  derived and/or modified sequence opt2 from neuraminidase__InfluenzaA__ADK90317

SEQ ID NO: 110696 - RNA, 1410 nt, Artificial Sequence; identical to SEQ ID NO: 110229
  derived and/or modified sequence opt2 from neuraminidase__InfluenzaA__ADK90321

SEQ ID NO: 110697 - RNA, 1410 nt, Artificial Sequence; identical to SEQ ID NO: 108250
  derived and/or modified sequence opt2 from neuraminidase__InfluenzaA__ADK90325

SEQ ID NO: 110698 - RNA, 1410 nt, Artificial Sequence
  derived and/or modified sequence opt2 from neuraminidase__InfluenzaA__ADK90329
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccgcuccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacgaggccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110699 - RNA, 1410 nt, Artificial Sequence
  derived and/or modified sequence opt2 from neuraminidase__InfluenzaA__ADK90333
augaaccccaaccagaagaucaucaccaucggcuccgucugcaugaccaucggcauggccaaccucauccuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110700 - RNA, 1410 nt, Artificial Sequence; identical to SEQ ID NO: 110229
  derived and/or modified sequence opt2 from neuraminidase__InfluenzaA__ADK90337

SEQ ID NO: 110701 - RNA, 1410 nt, Artificial Sequence; identical to SEQ ID NO: 109309
  derived and/or modified sequence opt2 from neuraminidase__InfluenzaA__ADK90341

SEQ ID NO: 110702 - RNA, 1410 nt, Artificial Sequence; identical to SEQ ID NO: 109309
  derived and/or modified sequence opt2 from neuraminidase__InfluenzaA__ADK90345

SEQ ID NO: 110703 - RNA, 1410 nt, Artificial Sequence; identical to SEQ ID NO: 109309
  derived and/or modified sequence opt2 from neuraminidase__InfluenzaA__ADK90349

SEQ ID NO: 110704 - RNA, 1410 nt, Artificial Sequence; identical to SEQ ID NO: 110229
  derived and/or modified sequence opt2 from neuraminidase__InfluenzaA__ADK90353

SEQ ID NO: 110705 - RNA, 1410 nt, Artificial Sequence; identical to SEQ ID NO: 108250
  derived and/or modified sequence opt2 from neuraminidase__InfluenzaA__ADK90357

SEQ ID NO: 110706 - RNA, 1410 nt, Artificial Sequence; identical to SEQ ID NO: 110229
  derived and/or modified sequence opt2 from neuraminidase__InfluenzaA__ADK90361

SEQ ID NO: 110707 - RNA, 1410 nt, Artificial Sequence; identical to SEQ ID NO: 109224
  derived and/or modified sequence opt2 from neuraminidase__InfluenzaA__ADK90365

SEQ ID NO: 110708 - RNA, 1410 nt, Artificial Sequence; identical to SEQ ID NO: 108250
  derived and/or modified sequence opt2 from neuraminidase__InfluenzaA__ADK90369

SEQ ID NO: 110709 - RNA, 1410 nt, Artificial Sequence; identical to SEQ ID NO: 108250
  derived and/or modified sequence opt2 from neuraminidase__InfluenzaA__ADK90373

SEQ ID NO: 110710 - RNA, 1410 nt, Artificial Sequence
  derived and/or modified sequence opt2 from neuraminidase__InfluenzaA__ADK90377
augaaccccaaccagaagaucaucaccaucggcuccgucugcaugaccaucggcaugaccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagauggacgcccccaacuaccacuacgaggagugcuccugcuaccccgacuccuccgagaucaucugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110711 - RNA, 1410 nt, Artificial Sequence; identical to SEQ ID NO: 110229
  derived and/or modified sequence opt2 from neuraminidase__InfluenzaA__ADK90381

SEQ ID NO: 110712 - RNA, 1410 nt, Artificial Sequence
  derived and/or modified sequence opt2 from neuraminidase__InfluenzaA__ADK90385
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucuccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcaccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110713 - RNA, 1410 nt, Artificial Sequence; identical to SEQ ID NO: 108250
  derived and/or modified sequence opt2 from neuraminidase__InfluenzaA__ADK90389

SEQ ID NO: 110714 - RNA, 1410 nt, Artificial Sequence; identical to SEQ ID NO: 110229
  derived and/or modified sequence opt2 from neuraminidase__InfluenzaA__ADK90393

SEQ ID NO: 110715 - RNA, 1410 nt, Artificial Sequence; identical to SEQ ID NO: 110141
  derived and/or modified sequence opt2 from neuraminidase__InfluenzaA__ADK90397

SEQ ID NO: 110716 - RNA, 1410 nt, Artificial Sequence; identical to SEQ ID NO: 108250
  derived and/or modified sequence opt2 from neuraminidase__InfluenzaA__ADK90401

SEQ ID NO: 110717 - RNA, 1410 nt, Artificial Sequence
  derived and/or modified sequence opt2 from neuraminidase__InfluenzaA__ADK90405
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcaccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110718 - RNA, 1410 nt, Artificial Sequence; identical to SEQ ID NO: 108250
  derived and/or modified sequence opt2 from neuraminidase__InfluenzaA__ADK90409

SEQ ID NO: 110719 - RNA, 1410 nt, Artificial Sequence
  derived and/or modified sequence opt2 from neuraminidase__InfluenzaA__ADK90413
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccauggccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110720 - RNA, 1410 nt, Artificial Sequence; identical to SEQ ID NO: 108250
  derived and/or modified sequence opt2 from neuraminidase__InfluenzaA__ADK90417

SEQ ID NO: 110721 - RNA, 1410 nt, Artificial Sequence; identical to SEQ ID NO: 108250
  derived and/or modified sequence opt2 from neuraminidase__InfluenzaA__ADK90421

SEQ ID NO: 110722 - RNA, 1410 nt, Artificial Sequence; identical to SEQ ID NO: 108250
  derived and/or modified sequence opt2 from neuraminidase__InfluenzaA__ADK90425

SEQ ID NO: 110723 - RNA, 1410 nt, Artificial Sequence; identical to SEQ ID NO: 108250
  derived and/or modified sequence opt2 from neuraminidase__InfluenzaA__ADK90429

SEQ ID NO: 110724 - RNA, 1410 nt, Artificial Sequence; identical to SEQ ID NO: 108111
  derived and/or modified sequence opt2 from neuraminidase__InfluenzaA__ADK94194

SEQ ID NO: 110725 - RNA, 1410 nt, Artificial Sequence; identical to SEQ ID NO: 108111
  derived and/or modified sequence opt2 from neuraminidase__InfluenzaA__ADK94205

SEQ ID NO: 110726 - RNA, 1410 nt, Artificial Sequence; identical to SEQ ID NO: 109417
  derived and/or modified sequence opt2 from neuraminidase__InfluenzaA__ADK94216

SEQ ID NO: 110727 - RNA, 1410 nt, Artificial Sequence; identical to SEQ ID NO: 108111
  derived and/or modified sequence opt2 from neuraminidase__InfluenzaA__ADK94227

SEQ ID NO: 110728 - RNA, 1410 nt, Artificial Sequence; identical to SEQ ID NO: 108111
  derived and/or modified sequence opt2 from neuraminidase__InfluenzaA__ADK94238

SEQ ID NO: 110729 - RNA, 1410 nt, Artificial Sequence; identical to SEQ ID NO: 110635
  derived and/or modified sequence opt2 from neuraminidase__InfluenzaA__ADK94260

SEQ ID NO: 110730 - RNA, 1410 nt, Artificial Sequence; identical to SEQ ID NO: 110635
  derived and/or modified sequence opt2 from neuraminidase__InfluenzaA__ADK94271

SEQ ID NO: 110731 - RNA, 1410 nt, Artificial Sequence; identical to SEQ ID NO: 108111
  derived and/or modified sequence opt2 from neuraminidase__InfluenzaA__ADK94293

SEQ ID NO: 110732 - RNA, 1410 nt, Artificial Sequence; identical to SEQ ID NO: 108111
  derived and/or modified sequence opt2 from neuraminidase__InfluenzaA__ADK94304

SEQ ID NO: 110733 - RNA, 1410 nt, Artificial Sequence
  derived and/or modified sequence opt2 from neuraminidase__InfluenzaA__ADK94326
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacauccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110734 - RNA, 1410 nt, Artificial Sequence; identical to SEQ ID NO: 109417
  derived and/or modified sequence opt2 from neuraminidase__InfluenzaA__ADK94337

SEQ ID NO: 110735 - RNA, 1410 nt, Artificial Sequence; identical to SEQ ID NO: 108111
  derived and/or modified sequence opt2 from neuraminidase__InfluenzaA__ADK94444

SEQ ID NO: 110736 - RNA, 1410 nt, Artificial Sequence
  derived and/or modified sequence opt2 from neuraminidase__InfluenzaA__ADK94479
augaaccccaaccagaagaucaucaccaucggcuccgucucccucaccaucuccaccaucugcuuccucaugcagaucgccauccucaccaccaccgucacccuccacuucaagcaguacgaguucaacuccccccccaacaaccaggucaugcucugcgagcccaccaccaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccggcguccucuggaccuccaacuccaucgucgucuucugcggcaccuccggcaccuacggcaccggcuccuggcccgacggcgccgacaucaaccucaugcccaucuga

SEQ ID NO: 110737 - RNA, 1410 nt, Artificial Sequence; identical to SEQ ID NO: 108111
  derived and/or modified sequence opt2 from neuraminidase__InfluenzaA__ADK94490

SEQ ID NO: 110738 - RNA, 1410 nt, Artificial Sequence; identical to SEQ ID NO: 108111
  derived and/or modified sequence opt2 from neuraminidase__InfluenzaA__ADK94501

SEQ ID NO: 110739 - RNA, 1410 nt, Artificial Sequence
  derived and/or modified sequence opt2 from neuraminidase__InfluenzaA__ADK94512
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggccgcaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110740 - RNA, 1410 nt, Artificial Sequence; identical to SEQ ID NO: 108111
  derived and/or modified sequence opt2 from neuraminidase__InfluenzaA__ADK94534

SEQ ID NO: 110741 - RNA, 1410 nt, Artificial Sequence; identical to SEQ ID NO: 110635
  derived and/or modified sequence opt2 from neuraminidase__InfluenzaA__ADK94556

SEQ ID NO: 110742 - RNA, 1410 nt, Artificial Sequence; identical to SEQ ID NO: 108111
  derived and/or modified sequence opt2 from neuraminidase__InfluenzaA__ADK94567

SEQ ID NO: 110743 - RNA, 1410 nt, Artificial Sequence; identical to SEQ ID NO: 108111
  derived and/or modified sequence opt2 from neuraminidase__InfluenzaA__ADK94578

SEQ ID NO: 110744 - RNA, 1410 nt, Artificial Sequence; identical to SEQ ID NO: 108111
  derived and/or modified sequence opt2 from neuraminidase__InfluenzaA__ADK94589

SEQ ID NO: 110745 - RNA, 1410 nt, Artificial Sequence; identical to SEQ ID NO: 109801
  derived and/or modified sequence opt2 from neuraminidase__InfluenzaA__ADK98504

SEQ ID NO: 110746 - RNA, 1410 nt, Artificial Sequence
  derived and/or modified sequence opt2 from neuraminidase__InfluenzaA__ADK98506
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccagaacgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110747 - RNA, 1410 nt, Artificial Sequence
  derived and/or modified sequence opt2 from neuraminidase__InfluenzaA__ADK98626
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaugaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110748 - RNA, 1410 nt, Artificial Sequence; identical to SEQ ID NO: 109417
  derived and/or modified sequence opt2 from neuraminidase__InfluenzaA__ADK98637

SEQ ID NO: 110749 - RNA, 1410 nt, Artificial Sequence
  derived and/or modified sequence opt2 from neuraminidase__InfluenzaA__ADK98648
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccgcggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110750 - RNA, 1410 nt, Artificial Sequence
  derived and/or modified sequence opt2 from neuraminidase__InfluenzaA__ADK98659
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110751 - RNA, 1410 nt, Artificial Sequence; identical to SEQ ID NO: 110635
  derived and/or modified sequence opt2 from neuraminidase__InfluenzaA__ADK98670

SEQ ID NO: 110752 - RNA, 1410 nt, Artificial Sequence
  derived and/or modified sequence opt2 from neuraminidase__InfluenzaA__ADK98681
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaccaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110753 - RNA, 1410 nt, Artificial Sequence
  derived and/or modified sequence opt2 from neuraminidase__InfluenzaA__ADK98703
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaccaaccgccaggucaucgucgaccgcggcaaccgcuccggcuacuccggcaucuucuccgucgagggcaagaacugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110754 - RNA, 1410 nt, Artificial Sequence; identical to SEQ ID NO: 109996
  derived and/or modified sequence opt2 from neuraminidase__InfluenzaA__ADK98725

SEQ ID NO: 110755 - RNA, 1410 nt, Artificial Sequence; identical to SEQ ID NO: 110635
  derived and/or modified sequence opt2 from neuraminidase__InfluenzaA__ADK98736

SEQ ID NO: 110756 - RNA, 1410 nt, Artificial Sequence
  derived and/or modified sequence opt2 from neuraminidase__InfluenzaA__ADK98747
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110757 - RNA, 1410 nt, Artificial Sequence
  derived and/or modified sequence opt2 from neuraminidase__InfluenzaA__ADK98758
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccaacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110758 - RNA, 1410 nt, Artificial Sequence; identical to SEQ ID NO: 109996
  derived and/or modified sequence opt2 from neuraminidase__InfluenzaA__ADK98769

SEQ ID NO: 110759 - RNA, 1410 nt, Artificial Sequence; identical to SEQ ID NO: 110550
  derived and/or modified sequence opt2 from neuraminidase__InfluenzaA__ADK98780

SEQ ID NO: 110760 - RNA, 1410 nt, Artificial Sequence; identical to SEQ ID NO: 109996
  derived and/or modified sequence opt2 from neuraminidase__InfluenzaA__ADK98791

SEQ ID NO: 110761 - RNA, 1410 nt, Artificial Sequence; identical to SEQ ID NO: 108111
  derived and/or modified sequence opt2 from neuraminidase__InfluenzaA__ADK98802

SEQ ID NO: 110762 - RNA, 1410 nt, Artificial Sequence
  derived and/or modified sequence opt2 from neuraminidase__InfluenzaA__ADK98813
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110763 - RNA, 1410 nt, Artificial Sequence; identical to SEQ ID NO: 108111
  derived and/or modified sequence opt2 from neuraminidase__InfluenzaA__ADK98824

SEQ ID NO: 110764 - RNA, 1410 nt, Artificial Sequence; identical to SEQ ID NO: 109996
  derived and/or modified sequence opt2 from neuraminidase__InfluenzaA__ADK98835

SEQ ID NO: 110765 - RNA, 1410 nt, Artificial Sequence; identical to SEQ ID NO: 110635
  derived and/or modified sequence opt2 from neuraminidase__InfluenzaA__ADK98846

SEQ ID NO: 110766 - RNA, 1410 nt, Artificial Sequence
  derived and/or modified sequence opt2 from neuraminidase__InfluenzaA__ADK98857
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110767 - RNA, 1410 nt, Artificial Sequence
  derived and/or modified sequence opt2 from neuraminidase__InfluenzaA__ADK98868
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 110768 - RNA, 1410 nt, Artificial Sequence
  derived and/or modified sequence opt2 from neuraminidase__InfluenzaA__ADK98879
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110769 - RNA, 1410 nt, Artificial Sequence; identical to SEQ ID NO: 110635
  derived and/or modified sequence opt2 from neuraminidase__InfluenzaA__ADK98890

SEQ ID NO: 110770 - RNA, 1410 nt, Artificial Sequence; identical to SEQ ID NO: 109996
  derived and/or modified sequence opt2 from neuraminidase__InfluenzaA__ADK98901

SEQ ID NO: 110771 - RNA, 1410 nt, Artificial Sequence; identical to SEQ ID NO: 110550
  derived and/or modified sequence opt2 from neuraminidase__InfluenzaA__ADK98912

SEQ ID NO: 110772 - RNA, 1410 nt, Artificial Sequence; identical to SEQ ID NO: 110635
  derived and/or modified sequence opt2 from neuraminidase__InfluenzaA__ADK98923

SEQ ID NO: 110773 - RNA, 1410 nt, Artificial Sequence; identical to SEQ ID NO: 109417
  derived and/or modified sequence opt2 from neuraminidase__InfluenzaA__ADK98945

SEQ ID NO: 110774 - RNA, 1410 nt, Artificial Sequence
  derived and/or modified sequence opt2 from neuraminidase__InfluenzaA__ADK98956
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccgucgucuccuccuacgucugcuccggccucgucggcgacaccccccgcaaguccgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110775 - RNA, 1410 nt, Artificial Sequence; identical to SEQ ID NO: 109996
  derived and/or modified sequence opt2 from neuraminidase__InfluenzaA__ADK98967

SEQ ID NO: 110776 - RNA, 1410 nt, Artificial Sequence; identical to SEQ ID NO: 110635
  derived and/or modified sequence opt2 from neuraminidase__InfluenzaA__ADK98978

SEQ ID NO: 110777 - RNA, 1410 nt, Artificial Sequence; identical to SEQ ID NO: 110774
  derived and/or modified sequence opt2 from neuraminidase__InfluenzaA__ADK98989

SEQ ID NO: 110778 - RNA, 1410 nt, Artificial Sequence; identical to SEQ ID NO: 108111
  derived and/or modified sequence opt2 from neuraminidase__InfluenzaA__ADK99000

SEQ ID NO: 110779 - RNA, 1410 nt, Artificial Sequence; identical to SEQ ID NO: 110774
  derived and/or modified sequence opt2 from neuraminidase__InfluenzaA__ADK99011

SEQ ID NO: 110780 - RNA, 1410 nt, Artificial Sequence
  derived and/or modified sequence opt2 from neuraminidase__InfluenzaA__ADK99022
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgaccccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110781 - RNA, 1410 nt, Artificial Sequence; identical to SEQ ID NO: 108111
  derived and/or modified sequence opt2 from neuraminidase__InfluenzaA__ADK99033

SEQ ID NO: 110782 - RNA, 1410 nt, Artificial Sequence
  derived and/or modified sequence opt2 from neuraminidase__InfluenzaA__ADK99044
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaagaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110783 - RNA, 1410 nt, Artificial Sequence
  derived and/or modified sequence opt2 from neuraminidase__InfluenzaA__ADK99055
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110784 - RNA, 1410 nt, Artificial Sequence
  derived and/or modified sequence opt2 from neuraminidase__InfluenzaA__ADK99066
augaaccccaaccagaagaucaucaccaucggcuccgucucccucaccaucuccaccaucugcuucuucaugcagaucgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaagaagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110785 - RNA, 1410 nt, Artificial Sequence
  derived and/or modified sequence opt2 from neuraminidase__InfluenzaA__ADK99077
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaaggucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110786 - RNA, 1410 nt, Artificial Sequence; identical to SEQ ID NO: 110550
  derived and/or modified sequence opt2 from neuraminidase__InfluenzaA__ADK99088

SEQ ID NO: 110787 - RNA, 1410 nt, Artificial Sequence; identical to SEQ ID NO: 109996
  derived and/or modified sequence opt2 from neuraminidase__InfluenzaA__ADK99099

SEQ ID NO: 110788 - RNA, 1410 nt, Artificial Sequence
  derived and/or modified sequence opt2 from neuraminidase__InfluenzaA__ADK99110
augaaccccaaccagaagaucaucaccaucggcuccgucucccucaccaucuccaccaucugcuucuucaugcagaucgccauccucgucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110789 - RNA, 1410 nt, Artificial Sequence; identical to SEQ ID NO: 110635
  derived and/or modified sequence opt2 from neuraminidase__InfluenzaA__ADK99121

SEQ ID NO: 110790 - RNA, 1410 nt, Artificial Sequence
  derived and/or modified sequence opt2 from neuraminidase__InfluenzaA__ADK99132
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccgucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110791 - RNA, 1410 nt, Artificial Sequence; identical to SEQ ID NO: 110635
  derived and/or modified sequence opt2 from neuraminidase__InfluenzaA__ADK99143

SEQ ID NO: 110792 - RNA, 1410 nt, Artificial Sequence; identical to SEQ ID NO: 108111
  derived and/or modified sequence opt2 from neuraminidase__InfluenzaA__ADK99154

SEQ ID NO: 110793 - RNA, 1410 nt, Artificial Sequence
  derived and/or modified sequence opt2 from neuraminidase__InfluenzaA__ADK99176
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccucaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110794 - RNA, 1410 nt, Artificial Sequence; identical to SEQ ID NO: 110785
  derived and/or modified sequence opt2 from neuraminidase__InfluenzaA__ADK99187

SEQ ID NO: 110795 - RNA, 1410 nt, Artificial Sequence; identical to SEQ ID NO: 109996
  derived and/or modified sequence opt2 from neuraminidase__InfluenzaA__ADK99198

SEQ ID NO: 110796 - RNA, 1410 nt, Artificial Sequence; identical to SEQ ID NO: 110635
  derived and/or modified sequence opt2 from neuraminidase__InfluenzaA__ADK99220

SEQ ID NO: 110797 - RNA, 1410 nt, Artificial Sequence
  derived and/or modified sequence opt2 from neuraminidase__InfluenzaA__ADK99231
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaacugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110798 - RNA, 1410 nt, Artificial Sequence
  derived and/or modified sequence opt2 from neuraminidase__InfluenzaA__ADK99242
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucaucgucuucugcggcaccuccggcaccuacggcaccggcuccuggcccgacggcgccgacaucaaccucaugcccaucuga

SEQ ID NO: 110799 - RNA, 1410 nt, Artificial Sequence
  derived and/or modified sequence opt2 from neuraminidase__InfluenzaA__ADK99253
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggccaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucacccucaugcccaucuga

SEQ ID NO: 110800 - RNA, 1410 nt, Artificial Sequence
  derived and/or modified sequence opt2 from neuraminidase__InfluenzaA__ADK99264
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccacaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110801 - RNA, 1410 nt, Artificial Sequence
  derived and/or modified sequence opt2 from neuraminidase__InfluenzaA__ADK99275
augaaccccaaccagaagaucaucaccaucggcuccgucucccucaccaucuccaccaucugcuucuucaugcagaucgccguccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccggcuaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110802 - RNA, 1410 nt, Artificial Sequence
  derived and/or modified sequence opt2 from neuraminidase__InfluenzaA__ADK99286
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaccccccgcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacauccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110803 - RNA, 1410 nt, Artificial Sequence; identical to SEQ ID NO: 109104
  derived and/or modified sequence opt2 from neuraminidase__InfluenzaA__ADK99297

SEQ ID NO: 110804 - RNA, 1410 nt, Artificial Sequence
  derived and/or modified sequence opt2 from neuraminidase__InfluenzaA__ADK99308
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcauccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110805 - RNA, 1413 nt, Artificial Sequence; identical to SEQ ID NO: 108973
  derived and/or modified sequence opt2 from neuraminidase__InfluenzaA__ADL14590

SEQ ID NO: 110806 - RNA, 1410 nt, Artificial Sequence; identical to SEQ ID NO: 109996
  derived and/or modified sequence opt2 from neuraminidase__InfluenzaA__ADL27992

SEQ ID NO: 110807 - RNA, 1410 nt, Artificial Sequence; identical to SEQ ID NO: 110635
  derived and/or modified sequence opt2 from neuraminidase__InfluenzaA__ADL28003

SEQ ID NO: 110808 - RNA, 1410 nt, Artificial Sequence; identical to SEQ ID NO: 110780
  derived and/or modified sequence opt2 from neuraminidase__InfluenzaA__ADL28014

SEQ ID NO: 110809 - RNA, 1410 nt, Artificial Sequence
  derived and/or modified sequence opt2 from neuraminidase__InfluenzaA__ADL28025
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaagaagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuaccucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110810 - RNA, 1410 nt, Artificial Sequence; identical to SEQ ID NO: 109996
  derived and/or modified sequence opt2 from neuraminidase__InfluenzaA__ADL28036

SEQ ID NO: 110811 - RNA, 1410 nt, Artificial Sequence; identical to SEQ ID NO: 108111
  derived and/or modified sequence opt2 from neuraminidase__InfluenzaA__ADL28047

SEQ ID NO: 110812 - RNA, 1410 nt, Artificial Sequence; identical to SEQ ID NO: 109417
  derived and/or modified sequence opt2 from neuraminidase__InfluenzaA__ADL28058

SEQ ID NO: 110813 - RNA, 1410 nt, Artificial Sequence; identical to SEQ ID NO: 110788
  derived and/or modified sequence opt2 from neuraminidase__InfluenzaA__ADL28069

SEQ ID NO: 110814 - RNA, 1410 nt, Artificial Sequence; identical to SEQ ID NO: 110635
  derived and/or modified sequence opt2 from neuraminidase__InfluenzaA__ADL28080

SEQ ID NO: 110815 - RNA, 1410 nt, Artificial Sequence; identical to SEQ ID NO: 109996
  derived and/or modified sequence opt2 from neuraminidase__InfluenzaA__ADL28091

SEQ ID NO: 110816 - RNA, 1410 nt, Artificial Sequence
  derived and/or modified sequence opt2 from neuraminidase__InfluenzaA__ADL28102
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110817 - RNA, 1410 nt, Artificial Sequence; identical to SEQ ID NO: 108111
  derived and/or modified sequence opt2 from neuraminidase__InfluenzaA__ADL28113

SEQ ID NO: 110818 - RNA, 1410 nt, Artificial Sequence
  derived and/or modified sequence opt2 from neuraminidase__InfluenzaA__ADL28129
augaaccccaaccagaagaucaucaccaucggcuccgucucccucaccaucuccaccaucugcuucuucaugcagaucgccauccucgucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagauccucuggaccuccaacuccaucgucgucuucugcggcaccuccggcaccuacggcaccggcuccuggcccgacggcgccaacaucaaccucaugcccaucuga

SEQ ID NO: 110819 - RNA, 1410 nt, Artificial Sequence
  derived and/or modified sequence opt2 from neuraminidase__InfluenzaA__ADL28140
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccaacaucaaccucaugcccaucuga

SEQ ID NO: 110820 - RNA, 1410 nt, Artificial Sequence; identical to SEQ ID NO: 109996
  derived and/or modified sequence opt2 from neuraminidase__InfluenzaA__ADL28151

SEQ ID NO: 110821 - RNA, 1410 nt, Artificial Sequence; identical to SEQ ID NO: 109417
  derived and/or modified sequence opt2 from neuraminidase__InfluenzaA__ADL28162

SEQ ID NO: 110822 - RNA, 1410 nt, Artificial Sequence; identical to SEQ ID NO: 110635
  derived and/or modified sequence opt2 from neuraminidase__InfluenzaA__ADL28173

SEQ ID NO: 110823 - RNA, 1410 nt, Artificial Sequence; identical to SEQ ID NO: 109996
  derived and/or modified sequence opt2 from neuraminidase__InfluenzaA__ADL28184

SEQ ID NO: 110824 - RNA, 1410 nt, Artificial Sequence
  derived and/or modified sequence opt2 from neuraminidase__InfluenzaA__ADL28195
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcgucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110825 - RNA, 1410 nt, Artificial Sequence; identical to SEQ ID NO: 110785
  derived and/or modified sequence opt2 from neuraminidase__InfluenzaA__ADL28206

SEQ ID NO: 110826 - RNA, 1410 nt, Artificial Sequence; identical to SEQ ID NO: 109104
  derived and/or modified sequence opt2 from neuraminidase__InfluenzaA__ADL28217

SEQ ID NO: 110827 - RNA, 1410 nt, Artificial Sequence; identical to SEQ ID NO: 109996
  derived and/or modified sequence opt2 from neuraminidase__InfluenzaA__ADL28228

SEQ ID NO: 110828 - RNA, 1410 nt, Artificial Sequence; identical to SEQ ID NO: 110635
  derived and/or modified sequence opt2 from neuraminidase__InfluenzaA__ADL28239

SEQ ID NO: 110829 - RNA, 1410 nt, Artificial Sequence; identical to SEQ ID NO: 109417
  derived and/or modified sequence opt2 from neuraminidase__InfluenzaA__ADL28250

SEQ ID NO: 110830 - RNA, 1410 nt, Artificial Sequence; identical to SEQ ID NO: 110635
  derived and/or modified sequence opt2 from neuraminidase__InfluenzaA__ADL28261

SEQ ID NO: 110831 - RNA, 1410 nt, Artificial Sequence; identical to SEQ ID NO: 109996
  derived and/or modified sequence opt2 from neuraminidase__InfluenzaA__ADL28373

SEQ ID NO: 110832 - RNA, 1410 nt, Artificial Sequence; identical to SEQ ID NO: 108115
  derived and/or modified sequence opt2 from neuraminidase__InfluenzaA__ADL28387

SEQ ID NO: 110833 - RNA, 1410 nt, Artificial Sequence
  derived and/or modified sequence opt2 from neuraminidase__InfluenzaA__ADL28391
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcguccccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110834 - RNA, 1410 nt, Artificial Sequence
  derived and/or modified sequence opt2 from neuraminidase__InfluenzaA__ADL28395
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcguccccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucgucaacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 110835 - RNA, 1410 nt, Artificial Sequence; identical to SEQ ID NO: 108250
  derived and/or modified sequence opt2 from neuraminidase__InfluenzaA__ADL29675

SEQ ID NO: 110836 - RNA, 1410 nt, Artificial Sequence; identical to SEQ ID NO: 108250
  derived and/or modified sequence opt2 from neuraminidase__InfluenzaA__ADL29685

SEQ ID NO: 110837 - RNA, 1410 nt, Artificial Sequence
  derived and/or modified sequence opt2 from neuraminidase__InfluenzaA__ADL29695
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaucgucggcugguccuggcccgacggcgccgagcuccccuucaccaucgacaaguga

SEQ ID NO: 110838 - RNA, 1410 nt, Artificial Sequence; identical to SEQ ID NO: 108250
  derived and/or modified sequence opt2 from neuraminidase__InfluenzaA__ADL29705

SEQ ID NO: 110839 - RNA, 1410 nt, Artificial Sequence; identical to SEQ ID NO: 110837
  derived and/or modified sequence opt2 from neuraminidase__InfluenzaA__ADL29733

SEQ ID NO: 110840 - RNA, 1410 nt, Artificial Sequence; identical to SEQ ID NO: 108250
  derived and/or modified sequence opt2 from neuraminidase__InfluenzaA__ADL29743

SEQ ID NO: 110841 - RNA, 1410 nt, Artificial Sequence
  derived and/or modified sequence opt2 from neuraminidase__InfluenzaA__ADL29753
augaaccccaaccagaagaucaucaccaucggcuccgucugcauggccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaucgucggcugguccuggcccgacggcgccgagcuccccuucaccaucgacaaguga

SEQ ID NO: 110842 - RNA, 1410 nt, Artificial Sequence; identical to SEQ ID NO: 108250
  derived and/or modified sequence opt2 from neuraminidase__InfluenzaA__ADL29763

SEQ ID NO: 110843 - RNA, 1410 nt, Artificial Sequence; identical to SEQ ID NO: 110837
  derived and/or modified sequence opt2 from neuraminidase__InfluenzaA__ADL29773

SEQ ID NO: 110844 - RNA, 1410 nt, Artificial Sequence; identical to SEQ ID NO: 108250
  derived and/or modified sequence opt2 from neuraminidase__InfluenzaA__ADL29783

SEQ ID NO: 110845 - RNA, 1410 nt, Artificial Sequence; identical to SEQ ID NO: 110837
  derived and/or modified sequence opt2 from neuraminidase__InfluenzaA__ADL29882

SEQ ID NO: 110846 - RNA, 1410 nt, Artificial Sequence
  derived and/or modified sequence opt2 from neuraminidase__InfluenzaA__ADL32020
augaaccccaaccagaagaucaucaccaucggcuccgucugcaugaccaucggcauggccaaccucauccuccagaucggcaacaucaucuccaccuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110847 - RNA, 1410 nt, Artificial Sequence; identical to SEQ ID NO: 110837
  derived and/or modified sequence opt2 from neuraminidase__InfluenzaA__ADL32030

SEQ ID NO: 110848 - RNA, 1410 nt, Artificial Sequence; identical to SEQ ID NO: 108250
  derived and/or modified sequence opt2 from neuraminidase__InfluenzaA__ADL32040

SEQ ID NO: 110849 - RNA, 1410 nt, Artificial Sequence; identical to SEQ ID NO: 108250
  derived and/or modified sequence opt2 from neuraminidase__InfluenzaA__ADL32050

SEQ ID NO: 110850 - RNA, 1410 nt, Artificial Sequence; identical to SEQ ID NO: 108250
  derived and/or modified sequence opt2 from neuraminidase__InfluenzaA__ADL32060

SEQ ID NO: 110851 - RNA, 1410 nt, Artificial Sequence; identical to SEQ ID NO: 108250
  derived and/or modified sequence opt2 from neuraminidase__InfluenzaA__ADL32093

SEQ ID NO: 110852 - RNA, 1410 nt, Artificial Sequence; identical to SEQ ID NO: 108250
  derived and/or modified sequence opt2 from neuraminidase__InfluenzaA__ADL32117

SEQ ID NO: 110853 - RNA, 1410 nt, Artificial Sequence; identical to SEQ ID NO: 108250
  derived and/or modified sequence opt2 from neuraminidase__InfluenzaA__ADL32347

SEQ ID NO: 110854 - RNA, 1410 nt, Artificial Sequence
  derived and/or modified sequence opt2 from neuraminidase__InfluenzaA__ADL32357
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccgucgacaaguga

SEQ ID NO: 110855 - RNA, 1410 nt, Artificial Sequence; identical to SEQ ID NO: 108250
  derived and/or modified sequence opt2 from neuraminidase__InfluenzaA__ADL32367

SEQ ID NO: 110856 - RNA, 1410 nt, Artificial Sequence; identical to SEQ ID NO: 108250
  derived and/or modified sequence opt2 from neuraminidase__InfluenzaA__ADL32377

SEQ ID NO: 110857 - RNA, 1410 nt, Artificial Sequence; identical to SEQ ID NO: 108250
  derived and/or modified sequence opt2 from neuraminidase__InfluenzaA__ADL32387

SEQ ID NO: 110858 - RNA, 1410 nt, Artificial Sequence; identical to SEQ ID NO: 108250
  derived and/or modified sequence opt2 from neuraminidase__InfluenzaA__ADL32397

SEQ ID NO: 110859 - RNA, 1410 nt, Artificial Sequence; identical to SEQ ID NO: 108250
  derived and/or modified sequence opt2 from neuraminidase__InfluenzaA__ADL32407

SEQ ID NO: 110860 - RNA, 1410 nt, Artificial Sequence; identical to SEQ ID NO: 108250
  derived and/or modified sequence opt2 from neuraminidase__InfluenzaA__ADL32417

SEQ ID NO: 110861 - RNA, 1410 nt, Artificial Sequence
  derived and/or modified sequence opt2 from neuraminidase__InfluenzaA__ADL32427
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaagaccaucuggaccuccggcuccaucaucuccuucugcggcgucaacuccgacaccgucggcugguccuggcccgacggcgccgagcuccccuucaccaucgacaaguga

SEQ ID NO: 110862 - RNA, 1410 nt, Artificial Sequence; identical to SEQ ID NO: 108250
  derived and/or modified sequence opt2 from neuraminidase__InfluenzaA__ADL32447

SEQ ID NO: 110863 - RNA, 1410 nt, Artificial Sequence
  derived and/or modified sequence opt2 from neuraminidase__InfluenzaA__ADL32457
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaaguccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucuccuccgacaccgucggcugguccuggcccgacggcgccgagcuccccuucaccaucgacaaguga

SEQ ID NO: 110864 - RNA, 1410 nt, Artificial Sequence; identical to SEQ ID NO: 109427
  derived and/or modified sequence opt2 from neuraminidase__InfluenzaA__ADL32487

SEQ ID NO: 110865 - RNA, 1410 nt, Artificial Sequence; identical to SEQ ID NO: 108250
  derived and/or modified sequence opt2 from neuraminidase__InfluenzaA__ADL32497

SEQ ID NO: 110866 - RNA, 1410 nt, Artificial Sequence; identical to SEQ ID NO: 108250
  derived and/or modified sequence opt2 from neuraminidase__InfluenzaA__ADL32507

SEQ ID NO: 110867 - RNA, 1410 nt, Artificial Sequence; identical to SEQ ID NO: 109712
  derived and/or modified sequence opt2 from neuraminidase__InfluenzaA__ADL32517

SEQ ID NO: 110868 - RNA, 1410 nt, Artificial Sequence; identical to SEQ ID NO: 109427
  derived and/or modified sequence opt2 from neuraminidase__InfluenzaA__ADL32527

SEQ ID NO: 110869 - RNA, 1410 nt, Artificial Sequence; identical to SEQ ID NO: 108250
  derived and/or modified sequence opt2 from neuraminidase__InfluenzaA__ADL32537

SEQ ID NO: 110870 - RNA, 1410 nt, Artificial Sequence; identical to SEQ ID NO: 109137
  derived and/or modified sequence opt2 from neuraminidase__InfluenzaA__ADL32547

SEQ ID NO: 110871 - RNA, 1410 nt, Artificial Sequence; identical to SEQ ID NO: 109601
  derived and/or modified sequence opt2 from neuraminidase__InfluenzaA__ADL32673

SEQ ID NO: 110872 - RNA, 1410 nt, Artificial Sequence; identical to SEQ ID NO: 108250
  derived and/or modified sequence opt2 from neuraminidase__InfluenzaA__ADL32683

SEQ ID NO: 110873 - RNA, 1410 nt, Artificial Sequence; identical to SEQ ID NO: 108240
  derived and/or modified sequence opt2 from neuraminidase__InfluenzaA__ADL32693

SEQ ID NO: 110874 - RNA, 1410 nt, Artificial Sequence; identical to SEQ ID NO: 109473
  derived and/or modified sequence opt2 from neuraminidase__InfluenzaA__ADL32703

SEQ ID NO: 110875 - RNA, 1410 nt, Artificial Sequence; identical to SEQ ID NO: 108240
  derived and/or modified sequence opt2 from neuraminidase__InfluenzaA__ADL32713

SEQ ID NO: 110876 - RNA, 1410 nt, Artificial Sequence; identical to SEQ ID NO: 108250
  derived and/or modified sequence opt2 from neuraminidase__InfluenzaA__ADL32723

SEQ ID NO: 110877 - RNA, 1410 nt, Artificial Sequence; identical to SEQ ID NO: 109931
  derived and/or modified sequence opt2 from neuraminidase__InfluenzaA__ADL32733

SEQ ID NO: 110878 - RNA, 1410 nt, Artificial Sequence; identical to SEQ ID NO: 109931
  derived and/or modified sequence opt2 from neuraminidase__InfluenzaA__ADL32743

SEQ ID NO: 110879 - RNA, 1410 nt, Artificial Sequence
  derived and/or modified sequence opt2 from neuraminidase__InfluenzaA__ADL39139
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucuccgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgagcgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110880 - RNA, 1413 nt, Artificial Sequence
  derived and/or modified sequence opt2 from neuraminidase__InfluenzaA__ADL39150
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110881 - RNA, 1410 nt, Artificial Sequence
  derived and/or modified sequence opt2 from neuraminidase__InfluenzaA__ADL39172
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110882 - RNA, 1410 nt, Artificial Sequence; identical to SEQ ID NO: 108111
  derived and/or modified sequence opt2 from neuraminidase__InfluenzaA__ADL39183

SEQ ID NO: 110883 - RNA, 1413 nt, Artificial Sequence; identical to SEQ ID NO: 110442
  derived and/or modified sequence opt2 from neuraminidase__InfluenzaA__ADL39194

SEQ ID NO: 110884 - RNA, 1410 nt, Artificial Sequence; identical to SEQ ID NO: 108111
  derived and/or modified sequence opt2 from neuraminidase__InfluenzaA__ADL39205

SEQ ID NO: 110885 - RNA, 1413 nt, Artificial Sequence; identical to SEQ ID NO: 108973
  derived and/or modified sequence opt2 from neuraminidase__InfluenzaA__ADL39227

SEQ ID NO: 110886 - RNA, 1413 nt, Artificial Sequence; identical to SEQ ID NO: 110442
  derived and/or modified sequence opt2 from neuraminidase__InfluenzaA__ADL39238

SEQ ID NO: 110887 - RNA, 1413 nt, Artificial Sequence; identical to SEQ ID NO: 110442
  derived and/or modified sequence opt2 from neuraminidase__InfluenzaA__ADL39249

SEQ ID NO: 110888 - RNA, 1413 nt, Artificial Sequence; identical to SEQ ID NO: 108973
  derived and/or modified sequence opt2 from neuraminidase__InfluenzaA__ADL39260

SEQ ID NO: 110889 - RNA, 1410 nt, Artificial Sequence
  derived and/or modified sequence opt2 from neuraminidase__InfluenzaA__ADL39282
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugcccccgccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaagguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110890 - RNA, 1413 nt, Artificial Sequence; identical to SEQ ID NO: 108973
  derived and/or modified sequence opt2 from neuraminidase__InfluenzaA__ADL39293

SEQ ID NO: 110891 - RNA, 1410 nt, Artificial Sequence
  derived and/or modified sequence opt2 from neuraminidase__InfluenzaA__ADL39304
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110892 - RNA, 1410 nt, Artificial Sequence; identical to SEQ ID NO: 108111
  derived and/or modified sequence opt2 from neuraminidase__InfluenzaA__ADL39326

SEQ ID NO: 110893 - RNA, 1413 nt, Artificial Sequence; identical to SEQ ID NO: 110442
  derived and/or modified sequence opt2 from neuraminidase__InfluenzaA__ADL39392

SEQ ID NO: 110894 - RNA, 1410 nt, Artificial Sequence
  derived and/or modified sequence opt2 from neuraminidase__InfluenzaA__ADL39403
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110895 - RNA, 1413 nt, Artificial Sequence; identical to SEQ ID NO: 108973
  derived and/or modified sequence opt2 from neuraminidase__InfluenzaA__ADL39425

SEQ ID NO: 110896 - RNA, 1413 nt, Artificial Sequence
  derived and/or modified sequence opt2 from neuraminidase__InfluenzaA__ADL39447
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucaccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110897 - RNA, 1413 nt, Artificial Sequence; identical to SEQ ID NO: 108973
  derived and/or modified sequence opt2 from neuraminidase__InfluenzaA__ADL39458

SEQ ID NO: 110898 - RNA, 1413 nt, Artificial Sequence
  derived and/or modified sequence opt2 from neuraminidase__InfluenzaA__ADL39469
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucgacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110899 - RNA, 1413 nt, Artificial Sequence
  derived and/or modified sequence opt2 from neuraminidase__InfluenzaA__ADL39480
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagauggucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110900 - RNA, 1410 nt, Artificial Sequence
  derived and/or modified sequence opt2 from neuraminidase__InfluenzaA__ADL39491
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccuccuccaucgucgucuucugcggcaccuccggcaccuacggcaccggcuccuggcccgacggcgccgacaucaaccucaugcccaucuga

SEQ ID NO: 110901 - RNA, 1410 nt, Artificial Sequence; identical to SEQ ID NO: 108250
  derived and/or modified sequence opt2 from neuraminidase__InfluenzaA__ADL41165

SEQ ID NO: 110902 - RNA, 1410 nt, Artificial Sequence
  derived and/or modified sequence opt2 from neuraminidase__InfluenzaA__ADL41175
augaaccccaaccagaagaucaucaccaucggcuccgucugcaugaccaucggcauggccaaccucauccuccagaucggcaacaucaucuccaccuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110903 - RNA, 1413 nt, Artificial Sequence
  derived and/or modified sequence opt2 from neuraminidase__InfluenzaA__ADL60255
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaacuacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggccgcggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110904 - RNA, 1413 nt, Artificial Sequence
  derived and/or modified sequence opt2 from neuraminidase__InfluenzaA__ADL60277
augaaccccaaccagcgcaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaacgucgucgccggcgaggacaagacccccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110905 - RNA, 1413 nt, Artificial Sequence
  derived and/or modified sequence opt2 from neuraminidase__InfluenzaA__ADL60288
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110906 - RNA, 1413 nt, Artificial Sequence
  derived and/or modified sequence opt2 from neuraminidase__InfluenzaA__ADL60299
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccaggaccucgacuaccagaucggcuacaucugcuccggcgucuucggcgacaacccccgccccaaggacggcaagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110907 - RNA, 1413 nt, Artificial Sequence; identical to SEQ ID NO: 108144
  derived and/or modified sequence opt2 from neuraminidase__InfluenzaA__ADL60310

SEQ ID NO: 110908 - RNA, 1413 nt, Artificial Sequence
  derived and/or modified sequence opt2 from neuraminidase__InfluenzaA__ADL60321
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcauggucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110909 - RNA, 1413 nt, Artificial Sequence
  derived and/or modified sequence opt2 from neuraminidase__InfluenzaA__ADL60332
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggccgcggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110910 - RNA, 1413 nt, Artificial Sequence; identical to SEQ ID NO: 108144
  derived and/or modified sequence opt2 from neuraminidase__InfluenzaA__ADL60343

SEQ ID NO: 110911 - RNA, 1413 nt, Artificial Sequence
  derived and/or modified sequence opt2 from neuraminidase__InfluenzaA__ADL60354
augaaccccaaccagcgcaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110912 - RNA, 1410 nt, Artificial Sequence
  derived and/or modified sequence opt2 from neuraminidase__InfluenzaA__ADL60365
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucucccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaccgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110913 - RNA, 1413 nt, Artificial Sequence
  derived and/or modified sequence opt2 from neuraminidase__InfluenzaA__ADL60376
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccggcaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 110914 - RNA, 1410 nt, Artificial Sequence; identical to SEQ ID NO: 108250
  derived and/or modified sequence opt2 from neuraminidase__InfluenzaA__ADM07137

SEQ ID NO: 110915 - RNA, 1410 nt, Artificial Sequence; identical to SEQ ID NO: 108250
  derived and/or modified sequence opt2 from neuraminidase__InfluenzaA__ADM07146

SEQ ID NO: 110916 - RNA, 1410 nt, Artificial Sequence; identical to SEQ ID NO: 108250
  derived and/or modified sequence opt2 from neuraminidase__InfluenzaA__ADM07156

SEQ ID NO: 110917 - RNA, 1410 nt, Artificial Sequence; identical to SEQ ID NO: 108250
  derived and/or modified sequence opt2 from neuraminidase__InfluenzaA__ADM07165

SEQ ID NO: 110918 - RNA, 1413 nt, Artificial Sequence; identical to SEQ ID NO: 108973
  derived and/or modified sequence opt2 from neuraminidase__InfluenzaA__ADM07474

SEQ ID NO: 110919 - RNA, 1413 nt, Artificial Sequence; identical to SEQ ID NO: 108973
  derived and/or modified sequence opt2 from neuraminidase__InfluenzaA__ADM07485

SEQ ID NO: 110920 - RNA, 1410 nt, Artificial Sequence
  derived and/or modified sequence opt2 from neuraminidase__InfluenzaA__ADM07496
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaacaucaugcccaucuga

SEQ ID NO: 110921 - RNA, 1410 nt, Artificial Sequence
  derived and/or modified sequence opt2 from neuraminidase__InfluenzaA__ADM07507
augaaccccaaccagaagaucaucaccaucggcuccgucucccucaccaucuccaccaucugcuucuucaugcagaccgccauccucaucaccaccgucacccuccacuucaagcaguucgaguucaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 110922 - RNA, 1410 nt, Artificial Sequence
  derived and/or modified sequence opt2 from neuraminidase__InfluenzaA__ADM12820
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 110923 - RNA, 1410 nt, Artificial Sequence; identical to SEQ ID NO: 110922
  derived and/or modified sequence opt2 from neuraminidase__InfluenzaA__ADM12831

SEQ ID NO: 110924 - RNA, 1410 nt, Artificial Sequence; identical to SEQ ID NO: 110922
  derived and/or modified sequence opt2 from neuraminidase__InfluenzaA__ADM12842

SEQ ID NO: 110925 - RNA, 1410 nt, Artificial Sequence; identical to SEQ ID NO: 110922
  derived and/or modified sequence opt2 from neuraminidase__InfluenzaA__ADM12853

SEQ ID NO: 110926 - RNA, 1410 nt, Artificial Sequence; identical to SEQ ID NO: 108250
  derived and/or modified sequence opt2 from neuraminidase__InfluenzaA__ADM12864

SEQ ID NO: 110927 - RNA, 1410 nt, Artificial Sequence; identical to SEQ ID NO: 108250
  derived and/or modified sequence opt2 from neuraminidase__InfluenzaA__ADM12874

SEQ ID NO: 110928 - RNA, 1410 nt, Artificial Sequence; identical to SEQ ID NO: 108250
  derived and/or modified sequence opt2 from neuraminidase__InfluenzaA__ADM12884

SEQ ID NO: 110929 - RNA, 1410 nt, Artificial Sequence
  derived and/or modified sequence opt2 from neuraminidase__InfluenzaA__ADM12894
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaguccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110930 - RNA, 1410 nt, Artificial Sequence; identical to SEQ ID NO: 108250
  derived and/or modified sequence opt2 from neuraminidase__InfluenzaA__ADM12904

SEQ ID NO: 110931 - RNA, 1410 nt, Artificial Sequence
  derived and/or modified sequence opt2 from neuraminidase__InfluenzaA__ADM12914
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccuacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110932 - RNA, 1410 nt, Artificial Sequence; identical to SEQ ID NO: 108250
  derived and/or modified sequence opt2 from neuraminidase__InfluenzaA__ADM12924

SEQ ID NO: 110933 - RNA, 1410 nt, Artificial Sequence; identical to SEQ ID NO: 108250
  derived and/or modified sequence opt2 from neuraminidase__InfluenzaA__ADM12934

SEQ ID NO: 110934 - RNA, 1410 nt, Artificial Sequence; identical to SEQ ID NO: 108250
  derived and/or modified sequence opt2 from neuraminidase__InfluenzaA__ADM12944

SEQ ID NO: 110935 - RNA, 1410 nt, Artificial Sequence; identical to SEQ ID NO: 108250
  derived and/or modified sequence opt2 from neuraminidase__InfluenzaA__ADM12954

SEQ ID NO: 110936 - RNA, 1410 nt, Artificial Sequence; identical to SEQ ID NO: 108250
  derived and/or modified sequence opt2 from neuraminidase__InfluenzaA__ADM12964

SEQ ID NO: 110937 - RNA, 1410 nt, Artificial Sequence; identical to SEQ ID NO: 109538
  derived and/or modified sequence opt2 from neuraminidase__InfluenzaA__ADM12974

SEQ ID NO: 110938 - RNA, 1410 nt, Artificial Sequence
  derived and/or modified sequence opt2 from neuraminidase__InfluenzaA__ADM12984
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccauccgcuccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110939 - RNA, 1410 nt, Artificial Sequence; identical to SEQ ID NO: 108250
  derived and/or modified sequence opt2 from neuraminidase__InfluenzaA__ADM12994

SEQ ID NO: 110940 - RNA, 1410 nt, Artificial Sequence; identical to SEQ ID NO: 108250
  derived and/or modified sequence opt2 from neuraminidase__InfluenzaA__ADM13004

SEQ ID NO: 110941 - RNA, 1410 nt, Artificial Sequence; identical to SEQ ID NO: 108250
  derived and/or modified sequence opt2 from neuraminidase__InfluenzaA__ADM13014

SEQ ID NO: 110942 - RNA, 1410 nt, Artificial Sequence
  derived and/or modified sequence opt2 from neuraminidase__InfluenzaA__ADM13034
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcaacugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110943 - RNA, 1410 nt, Artificial Sequence; identical to SEQ ID NO: 110163
  derived and/or modified sequence opt2 from neuraminidase__InfluenzaA__ADM13044

SEQ ID NO: 110944 - RNA, 1410 nt, Artificial Sequence; identical to SEQ ID NO: 109076
  derived and/or modified sequence opt2 from neuraminidase__InfluenzaA__ADM13054

SEQ ID NO: 110945 - RNA, 1410 nt, Artificial Sequence; identical to SEQ ID NO: 109427
  derived and/or modified sequence opt2 from neuraminidase__InfluenzaA__ADM13064

SEQ ID NO: 110946 - RNA, 1410 nt, Artificial Sequence
  derived and/or modified sequence opt2 from neuraminidase__InfluenzaA__ADM13074
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaaccucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110947 - RNA, 1410 nt, Artificial Sequence; identical to SEQ ID NO: 109427
  derived and/or modified sequence opt2 from neuraminidase__InfluenzaA__ADM13084

SEQ ID NO: 110948 - RNA, 1410 nt, Artificial Sequence
  derived and/or modified sequence opt2 from neuraminidase__InfluenzaA__ADM13094
augaaccccaaccagaagaucaucaccaucggcuccgucugcaugaccaucggcauggccaaccucauccuccagaucggcaacaccaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110949 - RNA, 1410 nt, Artificial Sequence; identical to SEQ ID NO: 109427
  derived and/or modified sequence opt2 from neuraminidase__InfluenzaA__ADM13104

SEQ ID NO: 110950 - RNA, 1410 nt, Artificial Sequence; identical to SEQ ID NO: 110152
  derived and/or modified sequence opt2 from neuraminidase__InfluenzaA__ADM13124

SEQ ID NO: 110951 - RNA, 1410 nt, Artificial Sequence
  derived and/or modified sequence opt2 from neuraminidase__InfluenzaA__ADM13134
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacacccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110952 - RNA, 1410 nt, Artificial Sequence
  derived and/or modified sequence opt2 from neuraminidase__InfluenzaA__ADM13154
augaaccccaaccagaagaucaucaccaucggcuccgucugcaugaccaucggcauggccaaccucauccuccagaucggcaacaucaucuccaucuggaucucccacuccauccagcucggcaaccagaagcagaucgagaccugcaaccaguccgucuucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110953 - RNA, 1410 nt, Artificial Sequence; identical to SEQ ID NO: 109680
  derived and/or modified sequence opt2 from neuraminidase__InfluenzaA__ADM13164

SEQ ID NO: 110954 - RNA, 1410 nt, Artificial Sequence; identical to SEQ ID NO: 108250
  derived and/or modified sequence opt2 from neuraminidase__InfluenzaA__ADM13174

SEQ ID NO: 110955 - RNA, 1410 nt, Artificial Sequence; identical to SEQ ID NO: 108250
  derived and/or modified sequence opt2 from neuraminidase__InfluenzaA__ADM13184

SEQ ID NO: 110956 - RNA, 1410 nt, Artificial Sequence; identical to SEQ ID NO: 108250
  derived and/or modified sequence opt2 from neuraminidase__InfluenzaA__ADM13194

SEQ ID NO: 110957 - RNA, 1410 nt, Artificial Sequence; identical to SEQ ID NO: 108250
  derived and/or modified sequence opt2 from neuraminidase__InfluenzaA__ADM13204

SEQ ID NO: 110958 - RNA, 1410 nt, Artificial Sequence; identical to SEQ ID NO: 109427
  derived and/or modified sequence opt2 from neuraminidase__InfluenzaA__ADM13214

SEQ ID NO: 110959 - RNA, 1410 nt, Artificial Sequence
  derived and/or modified sequence opt2 from neuraminidase__InfluenzaA__ADM13224
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccauccgcuccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccaagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110960 - RNA, 1410 nt, Artificial Sequence; identical to SEQ ID NO: 108250
  derived and/or modified sequence opt2 from neuraminidase__InfluenzaA__ADM13234

SEQ ID NO: 110961 - RNA, 1410 nt, Artificial Sequence; identical to SEQ ID NO: 109538
  derived and/or modified sequence opt2 from neuraminidase__InfluenzaA__ADM13244

SEQ ID NO: 110962 - RNA, 1410 nt, Artificial Sequence; identical to SEQ ID NO: 108604
  derived and/or modified sequence opt2 from neuraminidase__InfluenzaA__ADM13254

SEQ ID NO: 110963 - RNA, 1410 nt, Artificial Sequence; identical to SEQ ID NO: 109427
  derived and/or modified sequence opt2 from neuraminidase__InfluenzaA__ADM13264

SEQ ID NO: 110964 - RNA, 1410 nt, Artificial Sequence; identical to SEQ ID NO: 108250
  derived and/or modified sequence opt2 from neuraminidase__InfluenzaA__ADM13274

SEQ ID NO: 110965 - RNA, 1410 nt, Artificial Sequence; identical to SEQ ID NO: 108250
  derived and/or modified sequence opt2 from neuraminidase__InfluenzaA__ADM13284

SEQ ID NO: 110966 - RNA, 1410 nt, Artificial Sequence
  derived and/or modified sequence opt2 from neuraminidase__InfluenzaA__ADM13294
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcgcccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110967 - RNA, 1410 nt, Artificial Sequence; identical to SEQ ID NO: 108250
  derived and/or modified sequence opt2 from neuraminidase__InfluenzaA__ADM13304

SEQ ID NO: 110968 - RNA, 1410 nt, Artificial Sequence; identical to SEQ ID NO: 109712
  derived and/or modified sequence opt2 from neuraminidase__InfluenzaA__ADM13314

SEQ ID NO: 110969 - RNA, 1410 nt, Artificial Sequence; identical to SEQ ID NO: 108250
  derived and/or modified sequence opt2 from neuraminidase__InfluenzaA__ADM13324

SEQ ID NO: 110970 - RNA, 1410 nt, Artificial Sequence
  derived and/or modified sequence opt2 from neuraminidase__InfluenzaA__ADM13344
augaaccccaaccagaagaucaucaucaucggcuccgucugcaugaccaucggcauggccaaccucauccuccagaucggcaacaucaucuccaucuggauccuccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucgccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110971 - RNA, 1410 nt, Artificial Sequence; identical to SEQ ID NO: 110152
  derived and/or modified sequence opt2 from neuraminidase__InfluenzaA__ADM13354

SEQ ID NO: 110972 - RNA, 1410 nt, Artificial Sequence; identical to SEQ ID NO: 109427
  derived and/or modified sequence opt2 from neuraminidase__InfluenzaA__ADM13363

SEQ ID NO: 110973 - RNA, 1410 nt, Artificial Sequence
  derived and/or modified sequence opt2 from neuraminidase__InfluenzaA__ADM13464
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcaacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccaacaucaacuucaugcccaucuga

SEQ ID NO: 110974 - RNA, 1410 nt, Artificial Sequence
  derived and/or modified sequence opt2 from neuraminidase__InfluenzaA__ADM13465
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucaugcgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 110975 - RNA, 1410 nt, Artificial Sequence; identical to SEQ ID NO: 105607
  derived and/or modified sequence opt2 from neuraminidase__InfluenzaA__ADM13466

SEQ ID NO: 110976 - RNA, 1410 nt, Artificial Sequence
  derived and/or modified sequence opt2 from neuraminidase__InfluenzaA__ADM13467
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccuccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 110977 - RNA, 1410 nt, Artificial Sequence; identical to SEQ ID NO: 105607
  derived and/or modified sequence opt2 from neuraminidase__InfluenzaA__ADM13468

SEQ ID NO: 110978 - RNA, 1410 nt, Artificial Sequence
  derived and/or modified sequence opt2 from neuraminidase__InfluenzaA__ADM13469
augaaccccaaccagaagaucaucaccaucggcuccgucucccucaccaucgccaccgccugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 110979 - RNA, 1410 nt, Artificial Sequence
  derived and/or modified sequence opt2 from neuraminidase__InfluenzaA__ADM13470
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucaucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 110980 - RNA, 1410 nt, Artificial Sequence
  derived and/or modified sequence opt2 from neuraminidase__InfluenzaA__ADM13471
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgcaucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaacugccgcaaccccaacaacgagcgcggcaaccagggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 110981 - RNA, 1410 nt, Artificial Sequence; identical to SEQ ID NO: 108020
  derived and/or modified sequence opt2 from neuraminidase__InfluenzaA__ADM13472

SEQ ID NO: 110982 - RNA, 1410 nt, Artificial Sequence; identical to SEQ ID NO: 105607
  derived and/or modified sequence opt2 from neuraminidase__InfluenzaA__ADM13473

SEQ ID NO: 110983 - RNA, 1410 nt, Artificial Sequence; identical to SEQ ID NO: 108015
  derived and/or modified sequence opt2 from neuraminidase__InfluenzaA__ADM13474

SEQ ID NO: 110984 - RNA, 1410 nt, Artificial Sequence
  derived and/or modified sequence opt2 from neuraminidase__InfluenzaA__ADM14469
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccaugcgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110985 - RNA, 1410 nt, Artificial Sequence; identical to SEQ ID NO: 108250
  derived and/or modified sequence opt2 from neuraminidase__InfluenzaA__ADM14479

SEQ ID NO: 110986 - RNA, 1410 nt, Artificial Sequence; identical to SEQ ID NO: 108250
  derived and/or modified sequence opt2 from neuraminidase__InfluenzaA__ADM14499

SEQ ID NO: 110987 - RNA, 1410 nt, Artificial Sequence; identical to SEQ ID NO: 109763
  derived and/or modified sequence opt2 from neuraminidase__InfluenzaA__ADM14518

SEQ ID NO: 110988 - RNA, 1410 nt, Artificial Sequence; identical to SEQ ID NO: 110588
  derived and/or modified sequence opt2 from neuraminidase__InfluenzaA__ADM14527

SEQ ID NO: 110989 - RNA, 1410 nt, Artificial Sequence; identical to SEQ ID NO: 109681
  derived and/or modified sequence opt2 from neuraminidase__InfluenzaA__ADM14537

SEQ ID NO: 110990 - RNA, 1410 nt, Artificial Sequence; identical to SEQ ID NO: 108250
  derived and/or modified sequence opt2 from neuraminidase__InfluenzaA__ADM14546

SEQ ID NO: 110991 - RNA, 1410 nt, Artificial Sequence
  derived and/or modified sequence opt2 from neuraminidase__InfluenzaA__ADM14555
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuuccgcuacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110992 - RNA, 1410 nt, Artificial Sequence; identical to SEQ ID NO: 108250
  derived and/or modified sequence opt2 from neuraminidase__InfluenzaA__ADM14573

SEQ ID NO: 110993 - RNA, 1410 nt, Artificial Sequence; identical to SEQ ID NO: 108250
  derived and/or modified sequence opt2 from neuraminidase__InfluenzaA__ADM14582

SEQ ID NO: 110994 - RNA, 1410 nt, Artificial Sequence; identical to SEQ ID NO: 108250
  derived and/or modified sequence opt2 from neuraminidase__InfluenzaA__ADM14591

SEQ ID NO: 110995 - RNA, 1410 nt, Artificial Sequence
  derived and/or modified sequence opt2 from neuraminidase__InfluenzaA__ADM14601
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110996 - RNA, 1410 nt, Artificial Sequence
  derived and/or modified sequence opt2 from neuraminidase__InfluenzaA__ADM14611
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucuccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 110997 - RNA, 1410 nt, Artificial Sequence; identical to SEQ ID NO: 108250
  derived and/or modified sequence opt2 from neuraminidase__InfluenzaA__ADM14620

SEQ ID NO: 110998 - RNA, 1410 nt, Artificial Sequence; identical to SEQ ID NO: 108250
  derived and/or modified sequence opt2 from neuraminidase__InfluenzaA__ADM14629

SEQ ID NO: 110999 - RNA, 1410 nt, Artificial Sequence; identical to SEQ ID NO: 108250
  derived and/or modified sequence opt2 from neuraminidase__InfluenzaA__ADM14639

SEQ ID NO: 111000 - RNA, 1410 nt, Artificial Sequence; identical to SEQ ID NO: 108250
  derived and/or modified sequence opt2 from neuraminidase__InfluenzaA__ADM14657

SEQ ID NO: 111001 - RNA, 1410 nt, Artificial Sequence; identical to SEQ ID NO: 108250
  derived and/or modified sequence opt2 from neuraminidase__InfluenzaA__ADM14666

SEQ ID NO: 111002 - RNA, 1410 nt, Artificial Sequence; identical to SEQ ID NO: 108250
  derived and/or modified sequence opt2 from neuraminidase__InfluenzaA__ADM14684

SEQ ID NO: 111003 - RNA, 1410 nt, Artificial Sequence
  derived and/or modified sequence opt2 from neuraminidase__InfluenzaA__ADM14693
augaaccccaaccagaagaugaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111004 - RNA, 1410 nt, Artificial Sequence
  derived and/or modified sequence opt2 from neuraminidase__InfluenzaA__ADM14702
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgccuggaucggccgcaccaaguccaccuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111005 - RNA, 1410 nt, Artificial Sequence; identical to SEQ ID NO: 110152
  derived and/or modified sequence opt2 from neuraminidase__InfluenzaA__ADM14711

SEQ ID NO: 111006 - RNA, 1410 nt, Artificial Sequence
  derived and/or modified sequence opt2 from neuraminidase__InfluenzaA__ADM14720
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111007 - RNA, 1410 nt, Artificial Sequence
  derived and/or modified sequence opt2 from neuraminidase__InfluenzaA__ADM14730
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccgucuacuccaaggacaacuccauccgcaucggcuccaagggcgacguccucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111008 - RNA, 1350 nt, Artificial Sequence
  derived and/or modified sequence opt2 from neuraminidase__InfluenzaA__ADM14748
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111009 - RNA, 1410 nt, Artificial Sequence
  derived and/or modified sequence opt2 from neuraminidase__InfluenzaA__ADM14758
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111010 - RNA, 1410 nt, Artificial Sequence; identical to SEQ ID NO: 111009
  derived and/or modified sequence opt2 from neuraminidase__InfluenzaA__ADM14767

SEQ ID NO: 111011 - RNA, 1410 nt, Artificial Sequence; identical to SEQ ID NO: 108250
  derived and/or modified sequence opt2 from neuraminidase__InfluenzaA__ADM14777

SEQ ID NO: 111012 - RNA, 1410 nt, Artificial Sequence; identical to SEQ ID NO: 108250
  derived and/or modified sequence opt2 from neuraminidase__InfluenzaA__ADM14814

SEQ ID NO: 111013 - RNA, 1410 nt, Artificial Sequence; identical to SEQ ID NO: 108250
  derived and/or modified sequence opt2 from neuraminidase__InfluenzaA__ADM14823

SEQ ID NO: 111014 - RNA, 1410 nt, Artificial Sequence; identical to SEQ ID NO: 109873
  derived and/or modified sequence opt2 from neuraminidase__InfluenzaA__ADM14841

SEQ ID NO: 111015 - RNA, 1410 nt, Artificial Sequence; identical to SEQ ID NO: 109873
  derived and/or modified sequence opt2 from neuraminidase__InfluenzaA__ADM14859

SEQ ID NO: 111016 - RNA, 1410 nt, Artificial Sequence; identical to SEQ ID NO: 109387
  derived and/or modified sequence opt2 from neuraminidase__InfluenzaA__ADM14868

SEQ ID NO: 111017 - RNA, 1410 nt, Artificial Sequence; identical to SEQ ID NO: 109873
  derived and/or modified sequence opt2 from neuraminidase__InfluenzaA__ADM14878

SEQ ID NO: 111018 - RNA, 1410 nt, Artificial Sequence; identical to SEQ ID NO: 108250
  derived and/or modified sequence opt2 from neuraminidase__InfluenzaA__ADM14887

SEQ ID NO: 111019 - RNA, 1410 nt, Artificial Sequence
  derived and/or modified sequence opt2 from neuraminidase__InfluenzaA__ADM14896
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacguccucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111020 - RNA, 1410 nt, Artificial Sequence; identical to SEQ ID NO: 108250
  derived and/or modified sequence opt2 from neuraminidase__InfluenzaA__ADM14905

SEQ ID NO: 111021 - RNA, 1410 nt, Artificial Sequence; identical to SEQ ID NO: 108250
  derived and/or modified sequence opt2 from neuraminidase__InfluenzaA__ADM14923

SEQ ID NO: 111022 - RNA, 1410 nt, Artificial Sequence; identical to SEQ ID NO: 109538
  derived and/or modified sequence opt2 from neuraminidase__InfluenzaA__ADM14932

SEQ ID NO: 111023 - RNA, 1410 nt, Artificial Sequence; identical to SEQ ID NO: 108250
  derived and/or modified sequence opt2 from neuraminidase__InfluenzaA__ADM14950

SEQ ID NO: 111024 - RNA, 1410 nt, Artificial Sequence; identical to SEQ ID NO: 109268
  derived and/or modified sequence opt2 from neuraminidase__InfluenzaA__ADM14959

SEQ ID NO: 111025 - RNA, 1410 nt, Artificial Sequence
  derived and/or modified sequence opt2 from neuraminidase__InfluenzaA__ADM14977
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111026 - RNA, 1410 nt, Artificial Sequence; identical to SEQ ID NO: 109873
  derived and/or modified sequence opt2 from neuraminidase__InfluenzaA__ADM14987

SEQ ID NO: 111027 - RNA, 1410 nt, Artificial Sequence; identical to SEQ ID NO: 109417
  derived and/or modified sequence opt2 from neuraminidase__InfluenzaA__ADM26787

SEQ ID NO: 111028 - RNA, 1410 nt, Artificial Sequence; identical to SEQ ID NO: 109996
  derived and/or modified sequence opt2 from neuraminidase__InfluenzaA__ADM26798

SEQ ID NO: 111029 - RNA, 1410 nt, Artificial Sequence
  derived and/or modified sequence opt2 from neuraminidase__InfluenzaA__ADM26809
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccaccgucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 111030 - RNA, 1410 nt, Artificial Sequence
  derived and/or modified sequence opt2 from neuraminidase__InfluenzaA__ADM26820
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 111031 - RNA, 1350 nt, Artificial Sequence
  derived and/or modified sequence opt2 from neuraminidase__InfluenzaA__ADM31427
augaaccccaaccagaagaucaucaccaucggcuccgucugcaugaucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccacauggagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggggcaacaacauccuccgcacccaggaguccgagugcgccugcgucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacuccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccaugucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgaguucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 111032 - RNA, 1410 nt, Artificial Sequence
  derived and/or modified sequence opt2 from neuraminidase__InfluenzaA__ADM31481
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaagggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111033 - RNA, 1410 nt, Artificial Sequence; identical to SEQ ID NO: 108833
  derived and/or modified sequence opt2 from neuraminidase__InfluenzaA__ADM31491

SEQ ID NO: 111034 - RNA, 1410 nt, Artificial Sequence; identical to SEQ ID NO: 110455
  derived and/or modified sequence opt2 from neuraminidase__InfluenzaA__ADM31501

SEQ ID NO: 111035 - RNA, 1410 nt, Artificial Sequence; identical to SEQ ID NO: 108250
  derived and/or modified sequence opt2 from neuraminidase__InfluenzaA__ADM31511

SEQ ID NO: 111036 - RNA, 1410 nt, Artificial Sequence; identical to SEQ ID NO: 110451
  derived and/or modified sequence opt2 from neuraminidase__InfluenzaA__ADM31521

SEQ ID NO: 111037 - RNA, 1410 nt, Artificial Sequence; identical to SEQ ID NO: 108250
  derived and/or modified sequence opt2 from neuraminidase__InfluenzaA__ADM31531

SEQ ID NO: 111038 - RNA, 1410 nt, Artificial Sequence; identical to SEQ ID NO: 109538
  derived and/or modified sequence opt2 from neuraminidase__InfluenzaA__ADM31541

SEQ ID NO: 111039 - RNA, 1410 nt, Artificial Sequence; identical to SEQ ID NO: 108250
  derived and/or modified sequence opt2 from neuraminidase__InfluenzaA__ADM31551

SEQ ID NO: 111040 - RNA, 1410 nt, Artificial Sequence; identical to SEQ ID NO: 108250
  derived and/or modified sequence opt2 from neuraminidase__InfluenzaA__ADM31561

SEQ ID NO: 111041 - RNA, 1410 nt, Artificial Sequence; identical to SEQ ID NO: 108250
  derived and/or modified sequence opt2 from neuraminidase__InfluenzaA__ADM31571

SEQ ID NO: 111042 - RNA, 1410 nt, Artificial Sequence; identical to SEQ ID NO: 109427
  derived and/or modified sequence opt2 from neuraminidase__InfluenzaA__ADM31581

SEQ ID NO: 111043 - RNA, 1410 nt, Artificial Sequence; identical to SEQ ID NO: 108250
  derived and/or modified sequence opt2 from neuraminidase__InfluenzaA__ADM31601

SEQ ID NO: 111044 - RNA, 1410 nt, Artificial Sequence; identical to SEQ ID NO: 109538
  derived and/or modified sequence opt2 from neuraminidase__InfluenzaA__ADM31611

SEQ ID NO: 111045 - RNA, 1410 nt, Artificial Sequence
  derived and/or modified sequence opt2 from neuraminidase__InfluenzaA__ADM31621
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccucccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111046 - RNA, 1410 nt, Artificial Sequence; identical to SEQ ID NO: 109538
  derived and/or modified sequence opt2 from neuraminidase__InfluenzaA__ADM31631

SEQ ID NO: 111047 - RNA, 1410 nt, Artificial Sequence; identical to SEQ ID NO: 109427
  derived and/or modified sequence opt2 from neuraminidase__InfluenzaA__ADM31641

SEQ ID NO: 111048 - RNA, 1410 nt, Artificial Sequence; identical to SEQ ID NO: 109712
  derived and/or modified sequence opt2 from neuraminidase__InfluenzaA__ADM31651

SEQ ID NO: 111049 - RNA, 1410 nt, Artificial Sequence; identical to SEQ ID NO: 109427
  derived and/or modified sequence opt2 from neuraminidase__InfluenzaA__ADM31661

SEQ ID NO: 111050 - RNA, 1410 nt, Artificial Sequence
  derived and/or modified sequence opt2 from neuraminidase__InfluenzaA__ADM31671
augaaccccaaccagaagaucaucaccaucggcuccgucugcaugaccaucggcauggccaaccucauccuccagaucggcaacaucaucuccaucuggaucucccacuccacccagcucggcaaccagaaccagaucgagaccugcaaccaguccgucaucaccuacgagaacaacaccugggucaaccagaccuacgucaacaucuccaacaccaacuucgccgccggccaguccgucgucuccgccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111051 - RNA, 1410 nt, Artificial Sequence; identical to SEQ ID NO: 109538
  derived and/or modified sequence opt2 from neuraminidase__InfluenzaA__ADM31681

SEQ ID NO: 111052 - RNA, 1410 nt, Artificial Sequence
  derived and/or modified sequence opt2 from neuraminidase__InfluenzaA__ADM31691
augaaccccaaccagaagauccucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111053 - RNA, 1410 nt, Artificial Sequence; identical to SEQ ID NO: 108250
  derived and/or modified sequence opt2 from neuraminidase__InfluenzaA__ADM31701

SEQ ID NO: 111054 - RNA, 1410 nt, Artificial Sequence; identical to SEQ ID NO: 108250
  derived and/or modified sequence opt2 from neuraminidase__InfluenzaA__ADM31711

SEQ ID NO: 111055 - RNA, 1410 nt, Artificial Sequence; identical to SEQ ID NO: 109538
  derived and/or modified sequence opt2 from neuraminidase__InfluenzaA__ADM31721

SEQ ID NO: 111056 - RNA, 1410 nt, Artificial Sequence
  derived and/or modified sequence opt2 from neuraminidase__InfluenzaA__ADM31731
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggccgcaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111057 - RNA, 1410 nt, Artificial Sequence; identical to SEQ ID NO: 110625
  derived and/or modified sequence opt2 from neuraminidase__InfluenzaA__ADM31741

SEQ ID NO: 111058 - RNA, 1410 nt, Artificial Sequence; identical to SEQ ID NO: 108250
  derived and/or modified sequence opt2 from neuraminidase__InfluenzaA__ADM31751

SEQ ID NO: 111059 - RNA, 1410 nt, Artificial Sequence
  derived and/or modified sequence opt2 from neuraminidase__InfluenzaA__ADM31761
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccacaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucuccgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111060 - RNA, 1410 nt, Artificial Sequence
  derived and/or modified sequence opt2 from neuraminidase__InfluenzaA__ADM31771
augaaccccaaccagaagauccucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111061 - RNA, 1410 nt, Artificial Sequence
  derived and/or modified sequence opt2 from neuraminidase__InfluenzaA__ADM31801
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucaacaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111062 - RNA, 1410 nt, Artificial Sequence
  derived and/or modified sequence opt2 from neuraminidase__InfluenzaA__ADM31811
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaguucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111063 - RNA, 1410 nt, Artificial Sequence; identical to SEQ ID NO: 109427
  derived and/or modified sequence opt2 from neuraminidase__InfluenzaA__ADM31821

SEQ ID NO: 111064 - RNA, 1410 nt, Artificial Sequence; identical to SEQ ID NO: 108250
  derived and/or modified sequence opt2 from neuraminidase__InfluenzaA__ADM31831

SEQ ID NO: 111065 - RNA, 1410 nt, Artificial Sequence; identical to SEQ ID NO: 108250
  derived and/or modified sequence opt2 from neuraminidase__InfluenzaA__ADM31841

SEQ ID NO: 111066 - RNA, 1410 nt, Artificial Sequence
  derived and/or modified sequence opt2 from neuraminidase__InfluenzaA__ADM31851
augaaccccaaccagaagauccucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagcgcggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111067 - RNA, 1410 nt, Artificial Sequence; identical to SEQ ID NO: 108250
  derived and/or modified sequence opt2 from neuraminidase__InfluenzaA__ADM31861

SEQ ID NO: 111068 - RNA, 1410 nt, Artificial Sequence; identical to SEQ ID NO: 108250
  derived and/or modified sequence opt2 from neuraminidase__InfluenzaA__ADM31871

SEQ ID NO: 111069 - RNA, 1410 nt, Artificial Sequence
  derived and/or modified sequence opt2 from neuraminidase__InfluenzaA__ADM31881
augaaccccaaccagaagaucaucaccaucggcuccgucugcaugaccaucggcauggccaaccucauccuccagaucggcaacaccaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111070 - RNA, 1410 nt, Artificial Sequence; identical to SEQ ID NO: 108250
  derived and/or modified sequence opt2 from neuraminidase__InfluenzaA__ADM31891

SEQ ID NO: 111071 - RNA, 1410 nt, Artificial Sequence; identical to SEQ ID NO: 108240
  derived and/or modified sequence opt2 from neuraminidase__InfluenzaA__ADM31901

SEQ ID NO: 111072 - RNA, 1410 nt, Artificial Sequence; identical to SEQ ID NO: 109473
  derived and/or modified sequence opt2 from neuraminidase__InfluenzaA__ADM31911

SEQ ID NO: 111073 - RNA, 1410 nt, Artificial Sequence; identical to SEQ ID NO: 109473
  derived and/or modified sequence opt2 from neuraminidase__InfluenzaA__ADM31921

SEQ ID NO: 111074 - RNA, 1410 nt, Artificial Sequence; identical to SEQ ID NO: 109931
  derived and/or modified sequence opt2 from neuraminidase__InfluenzaA__ADM31931

SEQ ID NO: 111075 - RNA, 1410 nt, Artificial Sequence; identical to SEQ ID NO: 108240
  derived and/or modified sequence opt2 from neuraminidase__InfluenzaA__ADM31941

SEQ ID NO: 111076 - RNA, 1410 nt, Artificial Sequence; identical to SEQ ID NO: 109931
  derived and/or modified sequence opt2 from neuraminidase__InfluenzaA__ADM31951

SEQ ID NO: 111077 - RNA, 1410 nt, Artificial Sequence
  derived and/or modified sequence opt2 from neuraminidase__InfluenzaA__ADM31961
augaaccccaaccagaagaucaucaccaucggcuccgucugcauggccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111078 - RNA, 1410 nt, Artificial Sequence
  derived and/or modified sequence opt2 from neuraminidase__InfluenzaA__ADM31971
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcgucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111079 - RNA, 1410 nt, Artificial Sequence; identical to SEQ ID NO: 109473
  derived and/or modified sequence opt2 from neuraminidase__InfluenzaA__ADM31981

SEQ ID NO: 111080 - RNA, 1410 nt, Artificial Sequence; identical to SEQ ID NO: 108240
  derived and/or modified sequence opt2 from neuraminidase__InfluenzaA__ADM31991

SEQ ID NO: 111081 - RNA, 1410 nt, Artificial Sequence; identical to SEQ ID NO: 108240
  derived and/or modified sequence opt2 from neuraminidase__InfluenzaA__ADM32001

SEQ ID NO: 111082 - RNA, 1410 nt, Artificial Sequence; identical to SEQ ID NO: 108240
  derived and/or modified sequence opt2 from neuraminidase__InfluenzaA__ADM32011

SEQ ID NO: 111083 - RNA, 1410 nt, Artificial Sequence; identical to SEQ ID NO: 108250
  derived and/or modified sequence opt2 from neuraminidase__InfluenzaA__ADM32021

SEQ ID NO: 111084 - RNA, 1410 nt, Artificial Sequence; identical to SEQ ID NO: 109220
  derived and/or modified sequence opt2 from neuraminidase__InfluenzaA__ADM32031

SEQ ID NO: 111085 - RNA, 1410 nt, Artificial Sequence; identical to SEQ ID NO: 109974
  derived and/or modified sequence opt2 from neuraminidase__InfluenzaA__ADM32051

SEQ ID NO: 111086 - RNA, 1410 nt, Artificial Sequence; identical to SEQ ID NO: 108250
  derived and/or modified sequence opt2 from neuraminidase__InfluenzaA__ADM32061

SEQ ID NO: 111087 - RNA, 1410 nt, Artificial Sequence; identical to SEQ ID NO: 108250
  derived and/or modified sequence opt2 from neuraminidase__InfluenzaA__ADM32071

SEQ ID NO: 111088 - RNA, 1410 nt, Artificial Sequence; identical to SEQ ID NO: 108250
  derived and/or modified sequence opt2 from neuraminidase__InfluenzaA__ADM32081

SEQ ID NO: 111089 - RNA, 1410 nt, Artificial Sequence; identical to SEQ ID NO: 109473
  derived and/or modified sequence opt2 from neuraminidase__InfluenzaA__ADM32091

SEQ ID NO: 111090 - RNA, 1410 nt, Artificial Sequence; identical to SEQ ID NO: 108250
  derived and/or modified sequence opt2 from neuraminidase__InfluenzaA__ADM32101

SEQ ID NO: 111091 - RNA, 1410 nt, Artificial Sequence; identical to SEQ ID NO: 108250
  derived and/or modified sequence opt2 from neuraminidase__InfluenzaA__ADM32111

SEQ ID NO: 111092 - RNA, 1410 nt, Artificial Sequence; identical to SEQ ID NO: 109931
  derived and/or modified sequence opt2 from neuraminidase__InfluenzaA__ADM32554

SEQ ID NO: 111093 - RNA, 1410 nt, Artificial Sequence; identical to SEQ ID NO: 108240
  derived and/or modified sequence opt2 from neuraminidase__InfluenzaA__ADM32564

SEQ ID NO: 111094 - RNA, 1410 nt, Artificial Sequence; identical to SEQ ID NO: 109473
  derived and/or modified sequence opt2 from neuraminidase__InfluenzaA__ADM32574

SEQ ID NO: 111095 - RNA, 1410 nt, Artificial Sequence; identical to SEQ ID NO: 108250
  derived and/or modified sequence opt2 from neuraminidase__InfluenzaA__ADM32584

SEQ ID NO: 111096 - RNA, 1410 nt, Artificial Sequence; identical to SEQ ID NO: 109931
  derived and/or modified sequence opt2 from neuraminidase__InfluenzaA__ADM32594

SEQ ID NO: 111097 - RNA, 1410 nt, Artificial Sequence; identical to SEQ ID NO: 108250
  derived and/or modified sequence opt2 from neuraminidase__InfluenzaA__ADM32604

SEQ ID NO: 111098 - RNA, 1410 nt, Artificial Sequence; identical to SEQ ID NO: 108250
  derived and/or modified sequence opt2 from neuraminidase__InfluenzaA__ADM32614

SEQ ID NO: 111099 - RNA, 1410 nt, Artificial Sequence; identical to SEQ ID NO: 108250
  derived and/or modified sequence opt2 from neuraminidase__InfluenzaA__ADM32624

SEQ ID NO: 111100 - RNA, 1410 nt, Artificial Sequence; identical to SEQ ID NO: 109931
  derived and/or modified sequence opt2 from neuraminidase__InfluenzaA__ADM32634

SEQ ID NO: 111101 - RNA, 1410 nt, Artificial Sequence; identical to SEQ ID NO: 108250
  derived and/or modified sequence opt2 from neuraminidase__InfluenzaA__ADM32644

SEQ ID NO: 111102 - RNA, 1410 nt, Artificial Sequence; identical to SEQ ID NO: 108250
  derived and/or modified sequence opt2 from neuraminidase__InfluenzaA__ADM32664

SEQ ID NO: 111103 - RNA, 1410 nt, Artificial Sequence; identical to SEQ ID NO: 109473
  derived and/or modified sequence opt2 from neuraminidase__InfluenzaA__ADM32674

SEQ ID NO: 111104 - RNA, 1410 nt, Artificial Sequence; identical to SEQ ID NO: 108250
  derived and/or modified sequence opt2 from neuraminidase__InfluenzaA__ADM32684

SEQ ID NO: 111105 - RNA, 1410 nt, Artificial Sequence; identical to SEQ ID NO: 108240
  derived and/or modified sequence opt2 from neuraminidase__InfluenzaA__ADM32694

SEQ ID NO: 111106 - RNA, 1410 nt, Artificial Sequence; identical to SEQ ID NO: 108250
  derived and/or modified sequence opt2 from neuraminidase__InfluenzaA__ADM32704

SEQ ID NO: 111107 - RNA, 1410 nt, Artificial Sequence; identical to SEQ ID NO: 109974
  derived and/or modified sequence opt2 from neuraminidase__InfluenzaA__ADM32714

SEQ ID NO: 111108 - RNA, 1410 nt, Artificial Sequence; identical to SEQ ID NO: 109974
  derived and/or modified sequence opt2 from neuraminidase__InfluenzaA__ADM32724

SEQ ID NO: 111109 - RNA, 1410 nt, Artificial Sequence; identical to SEQ ID NO: 108250
  derived and/or modified sequence opt2 from neuraminidase__InfluenzaA__ADM32734

SEQ ID NO: 111110 - RNA, 1410 nt, Artificial Sequence; identical to SEQ ID NO: 109473
  derived and/or modified sequence opt2 from neuraminidase__InfluenzaA__ADM32744

SEQ ID NO: 111111 - RNA, 1410 nt, Artificial Sequence; identical to SEQ ID NO: 109974
  derived and/or modified sequence opt2 from neuraminidase__InfluenzaA__ADM32754

SEQ ID NO: 111112 - RNA, 1410 nt, Artificial Sequence; identical to SEQ ID NO: 109473
  derived and/or modified sequence opt2 from neuraminidase__InfluenzaA__ADM32764

SEQ ID NO: 111113 - RNA, 1410 nt, Artificial Sequence
  derived and/or modified sequence opt2 from neuraminidase__InfluenzaA__ADM32774
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaccaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111114 - RNA, 1410 nt, Artificial Sequence; identical to SEQ ID NO: 109220
  derived and/or modified sequence opt2 from neuraminidase__InfluenzaA__ADM32784

SEQ ID NO: 111115 - RNA, 1410 nt, Artificial Sequence; identical to SEQ ID NO: 109473
  derived and/or modified sequence opt2 from neuraminidase__InfluenzaA__ADM32794

SEQ ID NO: 111116 - RNA, 1410 nt, Artificial Sequence
  derived and/or modified sequence opt2 from neuraminidase__InfluenzaA__ADM32804
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucgagaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111117 - RNA, 1410 nt, Artificial Sequence
  derived and/or modified sequence opt2 from neuraminidase__InfluenzaA__ADM32814
augaaccccaaccagaagaucaucaccaucggcuccgucugcaugaccaucggcauggccaaccucauccuccagaucggcaacaucaucuccaucuggaucucccacuccauccagcucggcaaccagaaccaggucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111118 - RNA, 1410 nt, Artificial Sequence; identical to SEQ ID NO: 108250
  derived and/or modified sequence opt2 from neuraminidase__InfluenzaA__ADM32824

SEQ ID NO: 111119 - RNA, 1410 nt, Artificial Sequence; identical to SEQ ID NO: 109473
  derived and/or modified sequence opt2 from neuraminidase__InfluenzaA__ADM32834

SEQ ID NO: 111120 - RNA, 1410 nt, Artificial Sequence; identical to SEQ ID NO: 108240
  derived and/or modified sequence opt2 from neuraminidase__InfluenzaA__ADM32844

SEQ ID NO: 111121 - RNA, 1410 nt, Artificial Sequence
  derived and/or modified sequence opt2 from neuraminidase__InfluenzaA__ADM32854
augaaccccaaccagaagaucaucaccaucggcuccgucugcaccaccaucggcauggccaaccucauccuccagaucggcaacaucaucuccaucuggaucucccacuccauccaguucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgucggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111122 - RNA, 1410 nt, Artificial Sequence; identical to SEQ ID NO: 108240
  derived and/or modified sequence opt2 from neuraminidase__InfluenzaA__ADM32864

SEQ ID NO: 111123 - RNA, 1410 nt, Artificial Sequence; identical to SEQ ID NO: 108250
  derived and/or modified sequence opt2 from neuraminidase__InfluenzaA__ADM32874

SEQ ID NO: 111124 - RNA, 1410 nt, Artificial Sequence
  derived and/or modified sequence opt2 from neuraminidase__InfluenzaA__ADM32884
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgucggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111125 - RNA, 1410 nt, Artificial Sequence; identical to SEQ ID NO: 108250
  derived and/or modified sequence opt2 from neuraminidase__InfluenzaA__ADM32921

SEQ ID NO: 111126 - RNA, 1410 nt, Artificial Sequence; identical to SEQ ID NO: 108250
  derived and/or modified sequence opt2 from neuraminidase__InfluenzaA__ADM32931

SEQ ID NO: 111127 - RNA, 1410 nt, Artificial Sequence
  derived and/or modified sequence opt2 from neuraminidase__InfluenzaA__ADM32941
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111128 - RNA, 1410 nt, Artificial Sequence; identical to SEQ ID NO: 108250
  derived and/or modified sequence opt2 from neuraminidase__InfluenzaA__ADM32951

SEQ ID NO: 111129 - RNA, 1410 nt, Artificial Sequence; identical to SEQ ID NO: 108833
  derived and/or modified sequence opt2 from neuraminidase__InfluenzaA__ADM32960

SEQ ID NO: 111130 - RNA, 1410 nt, Artificial Sequence; identical to SEQ ID NO: 108250
  derived and/or modified sequence opt2 from neuraminidase__InfluenzaA__ADM32969

SEQ ID NO: 111131 - RNA, 1410 nt, Artificial Sequence; identical to SEQ ID NO: 108250
  derived and/or modified sequence opt2 from neuraminidase__InfluenzaA__ADM32979

SEQ ID NO: 111132 - RNA, 1410 nt, Artificial Sequence; identical to SEQ ID NO: 110152
  derived and/or modified sequence opt2 from neuraminidase__InfluenzaA__ADM32988

SEQ ID NO: 111133 - RNA, 1410 nt, Artificial Sequence; identical to SEQ ID NO: 110152
  derived and/or modified sequence opt2 from neuraminidase__InfluenzaA__ADM32997

SEQ ID NO: 111134 - RNA, 1410 nt, Artificial Sequence; identical to SEQ ID NO: 108250
  derived and/or modified sequence opt2 from neuraminidase__InfluenzaA__ADM33006

SEQ ID NO: 111135 - RNA, 1410 nt, Artificial Sequence; identical to SEQ ID NO: 110152
  derived and/or modified sequence opt2 from neuraminidase__InfluenzaA__ADM33015

SEQ ID NO: 111136 - RNA, 1410 nt, Artificial Sequence
  derived and/or modified sequence opt2 from neuraminidase__InfluenzaA__ADM33025
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcuccaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111137 - RNA, 1410 nt, Artificial Sequence; identical to SEQ ID NO: 108250
  derived and/or modified sequence opt2 from neuraminidase__InfluenzaA__ADM33042

SEQ ID NO: 111138 - RNA, 1410 nt, Artificial Sequence; identical to SEQ ID NO: 108250
  derived and/or modified sequence opt2 from neuraminidase__InfluenzaA__ADM33062

SEQ ID NO: 111139 - RNA, 1410 nt, Artificial Sequence
  derived and/or modified sequence opt2 from neuraminidase__InfluenzaA__ADM33071
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccaagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacggcgacaccgucggcugguccuggcccgacggcgccgagcuccccuucaccaucgacaaguga

SEQ ID NO: 111140 - RNA, 1410 nt, Artificial Sequence; identical to SEQ ID NO: 108250
  derived and/or modified sequence opt2 from neuraminidase__InfluenzaA__ADM33081

SEQ ID NO: 111141 - RNA, 1410 nt, Artificial Sequence; identical to SEQ ID NO: 109323
  derived and/or modified sequence opt2 from neuraminidase__InfluenzaA__ADM33091

SEQ ID NO: 111142 - RNA, 1410 nt, Artificial Sequence; identical to SEQ ID NO: 109323
  derived and/or modified sequence opt2 from neuraminidase__InfluenzaA__ADM33101

SEQ ID NO: 111143 - RNA, 1410 nt, Artificial Sequence; identical to SEQ ID NO: 109323
  derived and/or modified sequence opt2 from neuraminidase__InfluenzaA__ADM33111

SEQ ID NO: 111144 - RNA, 1410 nt, Artificial Sequence; identical to SEQ ID NO: 108250
  derived and/or modified sequence opt2 from neuraminidase__InfluenzaA__ADM33121

SEQ ID NO: 111145 - RNA, 1410 nt, Artificial Sequence; identical to SEQ ID NO: 108250
  derived and/or modified sequence opt2 from neuraminidase__InfluenzaA__ADM33130

SEQ ID NO: 111146 - RNA, 1410 nt, Artificial Sequence; identical to SEQ ID NO: 108250
  derived and/or modified sequence opt2 from neuraminidase__InfluenzaA__ADM33139

SEQ ID NO: 111147 - RNA, 1410 nt, Artificial Sequence; identical to SEQ ID NO: 108250
  derived and/or modified sequence opt2 from neuraminidase__InfluenzaA__ADM33149

SEQ ID NO: 111148 - RNA, 1410 nt, Artificial Sequence; identical to SEQ ID NO: 108250
  derived and/or modified sequence opt2 from neuraminidase__InfluenzaA__ADM33159

SEQ ID NO: 111149 - RNA, 1410 nt, Artificial Sequence; identical to SEQ ID NO: 108250
  derived and/or modified sequence opt2 from neuraminidase__InfluenzaA__ADM33169

SEQ ID NO: 111150 - RNA, 1410 nt, Artificial Sequence; identical to SEQ ID NO: 108250
  derived and/or modified sequence opt2 from neuraminidase__InfluenzaA__ADM33179

SEQ ID NO: 111151 - RNA, 1410 nt, Artificial Sequence; identical to SEQ ID NO: 108250
  derived and/or modified sequence opt2 from neuraminidase__InfluenzaA__ADM33188

SEQ ID NO: 111152 - RNA, 1410 nt, Artificial Sequence; identical to SEQ ID NO: 108250
  derived and/or modified sequence opt2 from neuraminidase__InfluenzaA__ADM33197

SEQ ID NO: 111153 - RNA, 1410 nt, Artificial Sequence; identical to SEQ ID NO: 108250
  derived and/or modified sequence opt2 from neuraminidase__InfluenzaA__ADM33206

SEQ ID NO: 111154 - RNA, 1410 nt, Artificial Sequence; identical to SEQ ID NO: 108250
  derived and/or modified sequence opt2 from neuraminidase__InfluenzaA__ADM33215

SEQ ID NO: 111155 - RNA, 1410 nt, Artificial Sequence; identical to SEQ ID NO: 108250
  derived and/or modified sequence opt2 from neuraminidase__InfluenzaA__ADM33224

SEQ ID NO: 111156 - RNA, 1410 nt, Artificial Sequence; identical to SEQ ID NO: 108250
  derived and/or modified sequence opt2 from neuraminidase__InfluenzaA__ADM33234

SEQ ID NO: 111157 - RNA, 1410 nt, Artificial Sequence; identical to SEQ ID NO: 108674
  derived and/or modified sequence opt2 from neuraminidase__InfluenzaA__ADM33243

SEQ ID NO: 111158 - RNA, 1410 nt, Artificial Sequence; identical to SEQ ID NO: 108250
  derived and/or modified sequence opt2 from neuraminidase__InfluenzaA__ADM33253

SEQ ID NO: 111159 - RNA, 1410 nt, Artificial Sequence; identical to SEQ ID NO: 108674
  derived and/or modified sequence opt2 from neuraminidase__InfluenzaA__ADM33262

SEQ ID NO: 111160 - RNA, 1410 nt, Artificial Sequence; identical to SEQ ID NO: 108280
  derived and/or modified sequence opt2 from neuraminidase__InfluenzaA__ADM33272

SEQ ID NO: 111161 - RNA, 1410 nt, Artificial Sequence; identical to SEQ ID NO: 108280
  derived and/or modified sequence opt2 from neuraminidase__InfluenzaA__ADM33282

SEQ ID NO: 111162 - RNA, 1410 nt, Artificial Sequence; identical to SEQ ID NO: 108250
  derived and/or modified sequence opt2 from neuraminidase__InfluenzaA__ADM33292

SEQ ID NO: 111163 - RNA, 1410 nt, Artificial Sequence; identical to SEQ ID NO: 108250
  derived and/or modified sequence opt2 from neuraminidase__InfluenzaA__ADM33302

SEQ ID NO: 111164 - RNA, 1410 nt, Artificial Sequence; identical to SEQ ID NO: 108240
  derived and/or modified sequence opt2 from neuraminidase__InfluenzaA__ADM33312

SEQ ID NO: 111165 - RNA, 1410 nt, Artificial Sequence; identical to SEQ ID NO: 108280
  derived and/or modified sequence opt2 from neuraminidase__InfluenzaA__ADM33322

SEQ ID NO: 111166 - RNA, 1410 nt, Artificial Sequence; identical to SEQ ID NO: 108280
  derived and/or modified sequence opt2 from neuraminidase__InfluenzaA__ADM33332

SEQ ID NO: 111167 - RNA, 1410 nt, Artificial Sequence; identical to SEQ ID NO: 108280
  derived and/or modified sequence opt2 from neuraminidase__InfluenzaA__ADM33342

SEQ ID NO: 111168 - RNA, 1410 nt, Artificial Sequence
  derived and/or modified sequence opt2 from neuraminidase__InfluenzaA__ADM33367
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucgucaccuacgagaacaacaccugggucaaccagaccuacgucaacaucuccaacaccaacuucgccgccggccaguccgucgucuccgucaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111169 - RNA, 1410 nt, Artificial Sequence; identical to SEQ ID NO: 108280
  derived and/or modified sequence opt2 from neuraminidase__InfluenzaA__ADM33377

SEQ ID NO: 111170 - RNA, 1410 nt, Artificial Sequence; identical to SEQ ID NO: 108280
  derived and/or modified sequence opt2 from neuraminidase__InfluenzaA__ADM33387

SEQ ID NO: 111171 - RNA, 1410 nt, Artificial Sequence; identical to SEQ ID NO: 108250
  derived and/or modified sequence opt2 from neuraminidase__InfluenzaA__ADM33397

SEQ ID NO: 111172 - RNA, 1410 nt, Artificial Sequence; identical to SEQ ID NO: 108250
  derived and/or modified sequence opt2 from neuraminidase__InfluenzaA__ADM33407

SEQ ID NO: 111173 - RNA, 1410 nt, Artificial Sequence; identical to SEQ ID NO: 108280
  derived and/or modified sequence opt2 from neuraminidase__InfluenzaA__ADM33417

SEQ ID NO: 111174 - RNA, 1410 nt, Artificial Sequence; identical to SEQ ID NO: 108250
  derived and/or modified sequence opt2 from neuraminidase__InfluenzaA__ADM33427

SEQ ID NO: 111175 - RNA, 1410 nt, Artificial Sequence
  derived and/or modified sequence opt2 from neuraminidase__InfluenzaA__ADM33437
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccuccgccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111176 - RNA, 1410 nt, Artificial Sequence; identical to SEQ ID NO: 108604
  derived and/or modified sequence opt2 from neuraminidase__InfluenzaA__ADM33443

SEQ ID NO: 111177 - RNA, 1410 nt, Artificial Sequence; identical to SEQ ID NO: 108250
  derived and/or modified sequence opt2 from neuraminidase__InfluenzaA__ADM52446

SEQ ID NO: 111178 - RNA, 1410 nt, Artificial Sequence; identical to SEQ ID NO: 108250
  derived and/or modified sequence opt2 from neuraminidase__InfluenzaA__ADM52456

SEQ ID NO: 111179 - RNA, 1410 nt, Artificial Sequence; identical to SEQ ID NO: 110455
  derived and/or modified sequence opt2 from neuraminidase__InfluenzaA__ADM52466

SEQ ID NO: 111180 - RNA, 1410 nt, Artificial Sequence; identical to SEQ ID NO: 108250
  derived and/or modified sequence opt2 from neuraminidase__InfluenzaA__ADM52486

SEQ ID NO: 111181 - RNA, 1410 nt, Artificial Sequence; identical to SEQ ID NO: 108240
  derived and/or modified sequence opt2 from neuraminidase__InfluenzaA__ADM52496

SEQ ID NO: 111182 - RNA, 1410 nt, Artificial Sequence; identical to SEQ ID NO: 108250
  derived and/or modified sequence opt2 from neuraminidase__InfluenzaA__ADM52506

SEQ ID NO: 111183 - RNA, 1410 nt, Artificial Sequence; identical to SEQ ID NO: 108240
  derived and/or modified sequence opt2 from neuraminidase__InfluenzaA__ADM52516

SEQ ID NO: 111184 - RNA, 1410 nt, Artificial Sequence; identical to SEQ ID NO: 108240
  derived and/or modified sequence opt2 from neuraminidase__InfluenzaA__ADM52527

SEQ ID NO: 111185 - RNA, 1410 nt, Artificial Sequence; identical to SEQ ID NO: 109473
  derived and/or modified sequence opt2 from neuraminidase__InfluenzaA__ADM52537

SEQ ID NO: 111186 - RNA, 1410 nt, Artificial Sequence; identical to SEQ ID NO: 109974
  derived and/or modified sequence opt2 from neuraminidase__InfluenzaA__ADM52547

SEQ ID NO: 111187 - RNA, 1410 nt, Artificial Sequence; identical to SEQ ID NO: 108240
  derived and/or modified sequence opt2 from neuraminidase__InfluenzaA__ADM52557

SEQ ID NO: 111188 - RNA, 1410 nt, Artificial Sequence; identical to SEQ ID NO: 108240
  derived and/or modified sequence opt2 from neuraminidase__InfluenzaA__ADM52567

SEQ ID NO: 111189 - RNA, 1410 nt, Artificial Sequence; identical to SEQ ID NO: 108240
  derived and/or modified sequence opt2 from neuraminidase__InfluenzaA__ADM52577

SEQ ID NO: 111190 - RNA, 1410 nt, Artificial Sequence; identical to SEQ ID NO: 108250
  derived and/or modified sequence opt2 from neuraminidase__InfluenzaA__ADM52587

SEQ ID NO: 111191 - RNA, 1410 nt, Artificial Sequence; identical to SEQ ID NO: 108250
  derived and/or modified sequence opt2 from neuraminidase__InfluenzaA__ADM52597

SEQ ID NO: 111192 - RNA, 1410 nt, Artificial Sequence; identical to SEQ ID NO: 108240
  derived and/or modified sequence opt2 from neuraminidase__InfluenzaA__ADM52607

SEQ ID NO: 111193 - RNA, 1410 nt, Artificial Sequence; identical to SEQ ID NO: 108240
  derived and/or modified sequence opt2 from neuraminidase__InfluenzaA__ADM52617

SEQ ID NO: 111194 - RNA, 1410 nt, Artificial Sequence; identical to SEQ ID NO: 109931
  derived and/or modified sequence opt2 from neuraminidase__InfluenzaA__ADM52627

SEQ ID NO: 111195 - RNA, 1410 nt, Artificial Sequence; identical to SEQ ID NO: 109473
  derived and/or modified sequence opt2 from neuraminidase__InfluenzaA__ADM52637

SEQ ID NO: 111196 - RNA, 1410 nt, Artificial Sequence; identical to SEQ ID NO: 109473
  derived and/or modified sequence opt2 from neuraminidase__InfluenzaA__ADM52647

SEQ ID NO: 111197 - RNA, 1410 nt, Artificial Sequence; identical to SEQ ID NO: 108240
  derived and/or modified sequence opt2 from neuraminidase__InfluenzaA__ADM52657

SEQ ID NO: 111198 - RNA, 1410 nt, Artificial Sequence; identical to SEQ ID NO: 109473
  derived and/or modified sequence opt2 from neuraminidase__InfluenzaA__ADM52667

SEQ ID NO: 111199 - RNA, 1410 nt, Artificial Sequence; identical to SEQ ID NO: 108240
  derived and/or modified sequence opt2 from neuraminidase__InfluenzaA__ADM52687

SEQ ID NO: 111200 - RNA, 1410 nt, Artificial Sequence; identical to SEQ ID NO: 108240
  derived and/or modified sequence opt2 from neuraminidase__InfluenzaA__ADM52697

SEQ ID NO: 111201 - RNA, 1410 nt, Artificial Sequence; identical to SEQ ID NO: 109931
  derived and/or modified sequence opt2 from neuraminidase__InfluenzaA__ADM52707

SEQ ID NO: 111202 - RNA, 1410 nt, Artificial Sequence
  derived and/or modified sequence opt2 from neuraminidase__InfluenzaA__ADM52717
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgccgucuccgucaagcucgucggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111203 - RNA, 1410 nt, Artificial Sequence
  derived and/or modified sequence opt2 from neuraminidase__InfluenzaA__ADM86402
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccgucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111204 - RNA, 1410 nt, Artificial Sequence; identical to SEQ ID NO: 108250
  derived and/or modified sequence opt2 from neuraminidase__InfluenzaA__ADM86412

SEQ ID NO: 111205 - RNA, 1410 nt, Artificial Sequence
  derived and/or modified sequence opt2 from neuraminidase__InfluenzaA__ADM86422
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgucgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaaggucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111206 - RNA, 1410 nt, Artificial Sequence; identical to SEQ ID NO: 109104
  derived and/or modified sequence opt2 from neuraminidase__InfluenzaA__ADM86432

SEQ ID NO: 111207 - RNA, 1410 nt, Artificial Sequence
  derived and/or modified sequence opt2 from neuraminidase__InfluenzaA__ADM86443
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaugaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111208 - RNA, 1410 nt, Artificial Sequence; identical to SEQ ID NO: 108833
  derived and/or modified sequence opt2 from neuraminidase__InfluenzaA__ADM86453

SEQ ID NO: 111209 - RNA, 1350 nt, Artificial Sequence
  derived and/or modified sequence opt2 from neuraminidase__InfluenzaA__ADM95377
augaaccccaaccagaagaucaucaccaucggcuccaucugcauggucaccggcaucgucucccucaugcuccaggucggcuccaugaucuccaucugggucucccacuccauccacaccggcaaccagcaccaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccaugggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacucccgcuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 111210 - RNA, 1410 nt, Artificial Sequence; identical to SEQ ID NO: 108250
  derived and/or modified sequence opt2 from neuraminidase__InfluenzaA__ADM95650

SEQ ID NO: 111211 - RNA, 1410 nt, Artificial Sequence; identical to SEQ ID NO: 108250
  derived and/or modified sequence opt2 from neuraminidase__InfluenzaA__ADM95651

SEQ ID NO: 111212 - RNA, 1410 nt, Artificial Sequence
  derived and/or modified sequence opt2 from neuraminidase__InfluenzaA__ADM95652
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaguucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcaacugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111213 - RNA, 1410 nt, Artificial Sequence
  derived and/or modified sequence opt2 from neuraminidase__InfluenzaA__ADM95654
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgccacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111214 - RNA, 1410 nt, Artificial Sequence
  derived and/or modified sequence opt2 from neuraminidase__InfluenzaA__ADM95655
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccuccgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111215 - RNA, 1410 nt, Artificial Sequence; identical to SEQ ID NO: 109862
  derived and/or modified sequence opt2 from neuraminidase__InfluenzaA__ADM95656

SEQ ID NO: 111216 - RNA, 1410 nt, Artificial Sequence; identical to SEQ ID NO: 109427
  derived and/or modified sequence opt2 from neuraminidase__InfluenzaA__ADM95658

SEQ ID NO: 111217 - RNA, 1410 nt, Artificial Sequence
  derived and/or modified sequence opt2 from neuraminidase__InfluenzaA__ADM95659
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucaucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111218 - RNA, 1410 nt, Artificial Sequence; identical to SEQ ID NO: 108250
  derived and/or modified sequence opt2 from neuraminidase__InfluenzaA__ADM95660

SEQ ID NO: 111219 - RNA, 1410 nt, Artificial Sequence
  derived and/or modified sequence opt2 from neuraminidase__InfluenzaA__ADM95661
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 111220 - RNA, 1410 nt, Artificial Sequence; identical to SEQ ID NO: 109862
  derived and/or modified sequence opt2 from neuraminidase__InfluenzaA__ADM95662

SEQ ID NO: 111221 - RNA, 1410 nt, Artificial Sequence
  derived and/or modified sequence opt2 from neuraminidase__InfluenzaA__ADM95663
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccaucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 111222 - RNA, 1410 nt, Artificial Sequence; identical to SEQ ID NO: 109862
  derived and/or modified sequence opt2 from neuraminidase__InfluenzaA__ADM95664

SEQ ID NO: 111223 - RNA, 1410 nt, Artificial Sequence; identical to SEQ ID NO: 109862
  derived and/or modified sequence opt2 from neuraminidase__InfluenzaA__ADM95665

SEQ ID NO: 111224 - RNA, 1410 nt, Artificial Sequence
  derived and/or modified sequence opt2 from neuraminidase__InfluenzaA__ADM95666
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuucaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 111225 - RNA, 1410 nt, Artificial Sequence; identical to SEQ ID NO: 109862
  derived and/or modified sequence opt2 from neuraminidase__InfluenzaA__ADM95667

SEQ ID NO: 111226 - RNA, 1410 nt, Artificial Sequence; identical to SEQ ID NO: 109862
  derived and/or modified sequence opt2 from neuraminidase__InfluenzaA__ADM95668

SEQ ID NO: 111227 - RNA, 1410 nt, Artificial Sequence; identical to SEQ ID NO: 108250
  derived and/or modified sequence opt2 from neuraminidase__InfluenzaA__ADM95669

SEQ ID NO: 111228 - RNA, 1410 nt, Artificial Sequence; identical to SEQ ID NO: 108250
  derived and/or modified sequence opt2 from neuraminidase__InfluenzaA__ADM95670

SEQ ID NO: 111229 - RNA, 1410 nt, Artificial Sequence
  derived and/or modified sequence opt2 from neuraminidase__InfluenzaA__ADM95672
augaaccccaaccagaagaucaucaccaucggcuccgucugcaugaccaucggcauggccaaccucauccuccagaucggcaacaucaucuccaucuggaucucccacaccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111230 - RNA, 1410 nt, Artificial Sequence; identical to SEQ ID NO: 108250
  derived and/or modified sequence opt2 from neuraminidase__InfluenzaA__ADM95673

SEQ ID NO: 111231 - RNA, 1410 nt, Artificial Sequence; identical to SEQ ID NO: 109862
  derived and/or modified sequence opt2 from neuraminidase__InfluenzaA__ADM95674

SEQ ID NO: 111232 - RNA, 1410 nt, Artificial Sequence; identical to SEQ ID NO: 108250
  derived and/or modified sequence opt2 from neuraminidase__InfluenzaA__ADM95675

SEQ ID NO: 111233 - RNA, 1410 nt, Artificial Sequence
  derived and/or modified sequence opt2 from neuraminidase__InfluenzaA__ADM95677
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 111234 - RNA, 1410 nt, Artificial Sequence
  derived and/or modified sequence opt2 from neuraminidase__InfluenzaA__ADM95678
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaguucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111235 - RNA, 1410 nt, Artificial Sequence; identical to SEQ ID NO: 111233
  derived and/or modified sequence opt2 from neuraminidase__InfluenzaA__ADM95679

SEQ ID NO: 111236 - RNA, 1410 nt, Artificial Sequence; identical to SEQ ID NO: 111233
  derived and/or modified sequence opt2 from neuraminidase__InfluenzaA__ADM95680

SEQ ID NO: 111237 - RNA, 1410 nt, Artificial Sequence; identical to SEQ ID NO: 108250
  derived and/or modified sequence opt2 from neuraminidase__InfluenzaA__ADM95681

SEQ ID NO: 111238 - RNA, 1410 nt, Artificial Sequence
  derived and/or modified sequence opt2 from neuraminidase__InfluenzaA__ADM95682
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaucugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111239 - RNA, 1410 nt, Artificial Sequence
  derived and/or modified sequence opt2 from neuraminidase__InfluenzaA__ADM95683
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccauguccuucugcggcgucaacuccgacaccgucggcugguccuggcccgacggcgccgagcuccccuucaccaucgacaaguga

SEQ ID NO: 111240 - RNA, 1410 nt, Artificial Sequence; identical to SEQ ID NO: 108250
  derived and/or modified sequence opt2 from neuraminidase__InfluenzaA__ADM95684

SEQ ID NO: 111241 - RNA, 1410 nt, Artificial Sequence
  derived and/or modified sequence opt2 from neuraminidase__InfluenzaA__ADM95685
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgccacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 111242 - RNA, 1410 nt, Artificial Sequence
  derived and/or modified sequence opt2 from neuraminidase__InfluenzaA__ADM95686
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111243 - RNA, 1410 nt, Artificial Sequence; identical to SEQ ID NO: 108250
  derived and/or modified sequence opt2 from neuraminidase__InfluenzaA__ADM95687

SEQ ID NO: 111244 - RNA, 1410 nt, Artificial Sequence
  derived and/or modified sequence opt2 from neuraminidase__InfluenzaA__ADM95688
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucacccgccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 111245 - RNA, 1410 nt, Artificial Sequence; identical to SEQ ID NO: 111242
  derived and/or modified sequence opt2 from neuraminidase__InfluenzaA__ADM95689

SEQ ID NO: 111246 - RNA, 1410 nt, Artificial Sequence
  derived and/or modified sequence opt2 from neuraminidase__InfluenzaA__ADM95690
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111247 - RNA, 1410 nt, Artificial Sequence; identical to SEQ ID NO: 108250
  derived and/or modified sequence opt2 from neuraminidase__InfluenzaA__ADM95691

SEQ ID NO: 111248 - RNA, 1410 nt, Artificial Sequence
  derived and/or modified sequence opt2 from neuraminidase__InfluenzaA__ADM95692
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucaucaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111249 - RNA, 1410 nt, Artificial Sequence; identical to SEQ ID NO: 108250
  derived and/or modified sequence opt2 from neuraminidase__InfluenzaA__ADM95693

SEQ ID NO: 111250 - RNA, 1410 nt, Artificial Sequence; identical to SEQ ID NO: 108250
  derived and/or modified sequence opt2 from neuraminidase__InfluenzaA__ADM95694

SEQ ID NO: 111251 - RNA, 1410 nt, Artificial Sequence; identical to SEQ ID NO: 108250
  derived and/or modified sequence opt2 from neuraminidase__InfluenzaA__ADM95695

SEQ ID NO: 111252 - RNA, 1410 nt, Artificial Sequence; identical to SEQ ID NO: 111242
  derived and/or modified sequence opt2 from neuraminidase__InfluenzaA__ADM95696

SEQ ID NO: 111253 - RNA, 1410 nt, Artificial Sequence; identical to SEQ ID NO: 109862
  derived and/or modified sequence opt2 from neuraminidase__InfluenzaA__ADM95697

SEQ ID NO: 111254 - RNA, 1413 nt, Artificial Sequence
  derived and/or modified sequence opt2 from neuraminidase__InfluenzaA__ADM95698
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacaacaccugggucaaccacaccuacgucaacaucaacaacaccaacgucgucgccgaggaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccagccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111255 - RNA, 1413 nt, Artificial Sequence
  derived and/or modified sequence opt2 from neuraminidase__InfluenzaA__ADM95699
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacaacaccugggucaaccacaccuacgucaacaucaacaacaccaacgucgucgccgaggaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111256 - RNA, 1413 nt, Artificial Sequence
  derived and/or modified sequence opt2 from neuraminidase__InfluenzaA__ADM95701
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacaacaccugggucaaccacaccuacgucaacaucaacaacaccaacgucgucgccgaggaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111257 - RNA, 1413 nt, Artificial Sequence
  derived and/or modified sequence opt2 from neuraminidase__InfluenzaA__ADM95702
augaaccccaaccagaagaucaucaccaucggcuccaucuccaucgccaucggcaucaucucccucaugcuccagaucggcaacaucaucuccaucugggccucccacuccauccagaccggccgccagaacaacaccggcaucugcaaccagcgcaucaucaccuacgagaacuccaccugggucaaccacaccuacgucaacaucaacaacaccaaggucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgaggucaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111258 - RNA, 1413 nt, Artificial Sequence
  derived and/or modified sequence opt2 from neuraminidase__InfluenzaA__ADM95704
augaaccccaaccagaagaucaucaccaucggcuccaucuccaucgccaucggcaucaucucccucaugcuccagaucggcaacaucgucuccaucugggccucccacuccauccagaccggcucccagaacaacaccggcaucugcaaccagcgcaucaucaccuacgagaacaacaccugggucaaccacaccuacgucaacaucaacaacaccaacgucgucgccgaggaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaaccgcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111259 - RNA, 1413 nt, Artificial Sequence
  derived and/or modified sequence opt2 from neuraminidase__InfluenzaA__ADM95705
augaaccccaaccagaagaucaucaccaucggcuccaucuccaucgccaucggcaucaucucccucaugcuccagaucggcaacaucaucuccaucugggccucccacuccauccagaccggccgccagaacaacaccggcaucugcaaccagcgcaucaucaccuacgagaacuccaccugggucaaccacaccuacgucaacaucaacaacaccaaggucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111260 - RNA, 1413 nt, Artificial Sequence; identical to SEQ ID NO: 111259
  derived and/or modified sequence opt2 from neuraminidase__InfluenzaA__ADM95706

SEQ ID NO: 111261 - RNA, 1413 nt, Artificial Sequence; identical to SEQ ID NO: 111259
  derived and/or modified sequence opt2 from neuraminidase__InfluenzaA__ADM95707

SEQ ID NO: 111262 - RNA, 1413 nt, Artificial Sequence; identical to SEQ ID NO: 108973
  derived and/or modified sequence opt2 from neuraminidase__InfluenzaA__ADM95708

SEQ ID NO: 111263 - RNA, 1410 nt, Artificial Sequence
  derived and/or modified sequence opt2 from neuraminidase__InfluenzaA__ADM95710
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacaacaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 111264 - RNA, 1410 nt, Artificial Sequence; identical to SEQ ID NO: 108111
  derived and/or modified sequence opt2 from neuraminidase__InfluenzaA__ADM95711

SEQ ID NO: 111265 - RNA, 1410 nt, Artificial Sequence; identical to SEQ ID NO: 108111
  derived and/or modified sequence opt2 from neuraminidase__InfluenzaA__ADM95712

SEQ ID NO: 111266 - RNA, 1410 nt, Artificial Sequence; identical to SEQ ID NO: 108111
  derived and/or modified sequence opt2 from neuraminidase__InfluenzaA__ADM95713

SEQ ID NO: 111267 - RNA, 1410 nt, Artificial Sequence
  derived and/or modified sequence opt2 from neuraminidase__InfluenzaA__ADM95714
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 111268 - RNA, 1410 nt, Artificial Sequence; identical to SEQ ID NO: 108111
  derived and/or modified sequence opt2 from neuraminidase__InfluenzaA__ADM95715

SEQ ID NO: 111269 - RNA, 1410 nt, Artificial Sequence; identical to SEQ ID NO: 111267
  derived and/or modified sequence opt2 from neuraminidase__InfluenzaA__ADM95716

SEQ ID NO: 111270 - RNA, 1410 nt, Artificial Sequence; identical to SEQ ID NO: 111267
  derived and/or modified sequence opt2 from neuraminidase__InfluenzaA__ADM95717

SEQ ID NO: 111271 - RNA, 1410 nt, Artificial Sequence; identical to SEQ ID NO: 108111
  derived and/or modified sequence opt2 from neuraminidase__InfluenzaA__ADM95718

SEQ ID NO: 111272 - RNA, 1410 nt, Artificial Sequence
  derived and/or modified sequence opt2 from neuraminidase__InfluenzaA__ADM95719
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111273 - RNA, 1410 nt, Artificial Sequence; identical to SEQ ID NO: 108111
  derived and/or modified sequence opt2 from neuraminidase__InfluenzaA__ADM95720

SEQ ID NO: 111274 - RNA, 1410 nt, Artificial Sequence; identical to SEQ ID NO: 108111
  derived and/or modified sequence opt2 from neuraminidase__InfluenzaA__ADM95721

SEQ ID NO: 111275 - RNA, 1410 nt, Artificial Sequence; identical to SEQ ID NO: 108111
  derived and/or modified sequence opt2 from neuraminidase__InfluenzaA__ADM95723

SEQ ID NO: 111276 - RNA, 1410 nt, Artificial Sequence
  derived and/or modified sequence opt2 from neuraminidase__InfluenzaA__ADM95724
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111277 - RNA, 1410 nt, Artificial Sequence
  derived and/or modified sequence opt2 from neuraminidase__InfluenzaA__ADM95725
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaucaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 111278 - RNA, 1410 nt, Artificial Sequence
  derived and/or modified sequence opt2 from neuraminidase__InfluenzaA__ADM95726
augaaccccaaccagaagaucaucaccaucggcuccgucucccucaccaucuccaccaucugcuucuucaugcagaucgccauccucaucaccgccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 111279 - RNA, 1410 nt, Artificial Sequence; identical to SEQ ID NO: 108111
  derived and/or modified sequence opt2 from neuraminidase__InfluenzaA__ADM95727

SEQ ID NO: 111280 - RNA, 1410 nt, Artificial Sequence
  derived and/or modified sequence opt2 from neuraminidase__InfluenzaA__ADM95728
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccgagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111281 - RNA, 1410 nt, Artificial Sequence
  derived and/or modified sequence opt2 from neuraminidase__InfluenzaA__ADM95729
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccucccgcucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111282 - RNA, 1410 nt, Artificial Sequence
  derived and/or modified sequence opt2 from neuraminidase__InfluenzaA__ADM95730
augaaccccaaccagaagaucaucaccaucggcuccgucucccucaccaucuccaccaucugcuucuucaugcagaucgccauccucaucaccaccgucacccuccacuucaagcaguacgaguucaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111283 - RNA, 1410 nt, Artificial Sequence
  derived and/or modified sequence opt2 from neuraminidase__InfluenzaA__ADM95732
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccgcuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111284 - RNA, 1410 nt, Artificial Sequence; identical to SEQ ID NO: 108111
  derived and/or modified sequence opt2 from neuraminidase__InfluenzaA__ADM95733

SEQ ID NO: 111285 - RNA, 1410 nt, Artificial Sequence; identical to SEQ ID NO: 108111
  derived and/or modified sequence opt2 from neuraminidase__InfluenzaA__ADM95734

SEQ ID NO: 111286 - RNA, 1410 nt, Artificial Sequence; identical to SEQ ID NO: 108111
  derived and/or modified sequence opt2 from neuraminidase__InfluenzaA__ADM95735

SEQ ID NO: 111287 - RNA, 1410 nt, Artificial Sequence; identical to SEQ ID NO: 108111
  derived and/or modified sequence opt2 from neuraminidase__InfluenzaA__ADM95736

SEQ ID NO: 111288 - RNA, 1410 nt, Artificial Sequence
  derived and/or modified sequence opt2 from neuraminidase__InfluenzaA__ADM95737
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggccgcgccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgacguccucuggaccuccaacuccaucgucgucuucugcggcaccuccggcaccuacggcaccggcuccuggcccgacggcgccgacaucaaccucaugcccaucuga

SEQ ID NO: 111289 - RNA, 1410 nt, Artificial Sequence; identical to SEQ ID NO: 108111
  derived and/or modified sequence opt2 from neuraminidase__InfluenzaA__ADM95738

SEQ ID NO: 111290 - RNA, 1410 nt, Artificial Sequence; identical to SEQ ID NO: 108111
  derived and/or modified sequence opt2 from neuraminidase__InfluenzaA__ADM95739

SEQ ID NO: 111291 - RNA, 1410 nt, Artificial Sequence
  derived and/or modified sequence opt2 from neuraminidase__InfluenzaA__ADM95740
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgacaucaaccucaugcccaucuga

SEQ ID NO: 111292 - RNA, 1410 nt, Artificial Sequence; identical to SEQ ID NO: 111267
  derived and/or modified sequence opt2 from neuraminidase__InfluenzaA__ADM95741

SEQ ID NO: 111293 - RNA, 1410 nt, Artificial Sequence; identical to SEQ ID NO: 108111
  derived and/or modified sequence opt2 from neuraminidase__InfluenzaA__ADM95742

SEQ ID NO: 111294 - RNA, 1410 nt, Artificial Sequence
  derived and/or modified sequence opt2 from neuraminidase__InfluenzaA__ADM95743
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111295 - RNA, 1410 nt, Artificial Sequence; identical to SEQ ID NO: 108111
  derived and/or modified sequence opt2 from neuraminidase__InfluenzaA__ADM95744

SEQ ID NO: 111296 - RNA, 1410 nt, Artificial Sequence; identical to SEQ ID NO: 108250
  derived and/or modified sequence opt2 from neuraminidase__InfluenzaA__ADN05229

SEQ ID NO: 111297 - RNA, 1413 nt, Artificial Sequence; identical to SEQ ID NO: 108973
  derived and/or modified sequence opt2 from neuraminidase__InfluenzaA__ADN06292

SEQ ID NO: 111298 - RNA, 1413 nt, Artificial Sequence; identical to SEQ ID NO: 110442
  derived and/or modified sequence opt2 from neuraminidase__InfluenzaA__ADN06303

SEQ ID NO: 111299 - RNA, 1413 nt, Artificial Sequence
  derived and/or modified sequence opt2 from neuraminidase__InfluenzaA__ADN06314
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgaggucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 111300 - RNA, 1413 nt, Artificial Sequence; identical to SEQ ID NO: 110442
  derived and/or modified sequence opt2 from neuraminidase__InfluenzaA__ADN06325

SEQ ID NO: 111301 - RNA, 1413 nt, Artificial Sequence
  derived and/or modified sequence opt2 from neuraminidase__InfluenzaA__ADN06347
augaaccccaaccagaagaucaucaccaucggcuccaucuccaucgccaucggcaucaucucccucaugcuccagaucggcaacaucaucuccaucugggccucccacuccauccagaccgagucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaugggcuacaucugcuccggcgucuucggcgacaacccccgccccgaggacggcgagggcuccugcaaccccgucaacgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111302 - RNA, 1410 nt, Artificial Sequence; identical to SEQ ID NO: 110922
  derived and/or modified sequence opt2 from neuraminidase__InfluenzaA__ADN06369

SEQ ID NO: 111303 - RNA, 1410 nt, Artificial Sequence; identical to SEQ ID NO: 108250
  derived and/or modified sequence opt2 from neuraminidase__InfluenzaA__ADN26031

SEQ ID NO: 111304 - RNA, 1410 nt, Artificial Sequence; identical to SEQ ID NO: 108250
  derived and/or modified sequence opt2 from neuraminidase__InfluenzaA__ADN26032

SEQ ID NO: 111305 - RNA, 1410 nt, Artificial Sequence; identical to SEQ ID NO: 108250
  derived and/or modified sequence opt2 from neuraminidase__InfluenzaA__ADN26033

SEQ ID NO: 111306 - RNA, 1410 nt, Artificial Sequence; identical to SEQ ID NO: 108250
  derived and/or modified sequence opt2 from neuraminidase__InfluenzaA__ADN26034

SEQ ID NO: 111307 - RNA, 1410 nt, Artificial Sequence; identical to SEQ ID NO: 108250
  derived and/or modified sequence opt2 from neuraminidase__InfluenzaA__ADN26035

SEQ ID NO: 111308 - RNA, 1410 nt, Artificial Sequence; identical to SEQ ID NO: 108250
  derived and/or modified sequence opt2 from neuraminidase__InfluenzaA__ADN26036

SEQ ID NO: 111309 - RNA, 1410 nt, Artificial Sequence
  derived and/or modified sequence opt2 from neuraminidase__InfluenzaA__ADN26037
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaucgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111310 - RNA, 1410 nt, Artificial Sequence; identical to SEQ ID NO: 108250
  derived and/or modified sequence opt2 from neuraminidase__InfluenzaA__ADN26038

SEQ ID NO: 111311 - RNA, 1410 nt, Artificial Sequence; identical to SEQ ID NO: 108250
  derived and/or modified sequence opt2 from neuraminidase__InfluenzaA__ADN26041

SEQ ID NO: 111312 - RNA, 1410 nt, Artificial Sequence; identical to SEQ ID NO: 108250
  derived and/or modified sequence opt2 from neuraminidase__InfluenzaA__ADN26042

SEQ ID NO: 111313 - RNA, 1410 nt, Artificial Sequence
  derived and/or modified sequence opt2 from neuraminidase__InfluenzaA__ADN26043
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccaggucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111314 - RNA, 1410 nt, Artificial Sequence; identical to SEQ ID NO: 108250
  derived and/or modified sequence opt2 from neuraminidase__InfluenzaA__ADN26044

SEQ ID NO: 111315 - RNA, 1410 nt, Artificial Sequence; identical to SEQ ID NO: 108250
  derived and/or modified sequence opt2 from neuraminidase__InfluenzaA__ADN26045

SEQ ID NO: 111316 - RNA, 1410 nt, Artificial Sequence
  derived and/or modified sequence opt2 from neuraminidase__InfluenzaA__ADN26047
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccauggucuccgucaagcucaccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111317 - RNA, 1410 nt, Artificial Sequence; identical to SEQ ID NO: 108250
  derived and/or modified sequence opt2 from neuraminidase__InfluenzaA__ADN26048

SEQ ID NO: 111318 - RNA, 1410 nt, Artificial Sequence; identical to SEQ ID NO: 108250
  derived and/or modified sequence opt2 from neuraminidase__InfluenzaA__ADN26049

SEQ ID NO: 111319 - RNA, 1410 nt, Artificial Sequence; identical to SEQ ID NO: 108250
  derived and/or modified sequence opt2 from neuraminidase__InfluenzaA__ADN26050

SEQ ID NO: 111320 - RNA, 1410 nt, Artificial Sequence; identical to SEQ ID NO: 108250
  derived and/or modified sequence opt2 from neuraminidase__InfluenzaA__ADN26051

SEQ ID NO: 111321 - RNA, 1410 nt, Artificial Sequence; identical to SEQ ID NO: 108250
  derived and/or modified sequence opt2 from neuraminidase__InfluenzaA__ADN26052

SEQ ID NO: 111322 - RNA, 1410 nt, Artificial Sequence; identical to SEQ ID NO: 108240
  derived and/or modified sequence opt2 from neuraminidase__InfluenzaA__ADN26053

SEQ ID NO: 111323 - RNA, 1410 nt, Artificial Sequence; identical to SEQ ID NO: 108250
  derived and/or modified sequence opt2 from neuraminidase__InfluenzaA__ADN26054

SEQ ID NO: 111324 - RNA, 1410 nt, Artificial Sequence; identical to SEQ ID NO: 108250
  derived and/or modified sequence opt2 from neuraminidase__InfluenzaA__ADN26057

SEQ ID NO: 111325 - RNA, 1410 nt, Artificial Sequence; identical to SEQ ID NO: 108250
  derived and/or modified sequence opt2 from neuraminidase__InfluenzaA__ADN26058

SEQ ID NO: 111326 - RNA, 1410 nt, Artificial Sequence; identical to SEQ ID NO: 108250
  derived and/or modified sequence opt2 from neuraminidase__InfluenzaA__ADN26059

SEQ ID NO: 111327 - RNA, 1410 nt, Artificial Sequence; identical to SEQ ID NO: 108617
  derived and/or modified sequence opt2 from neuraminidase__InfluenzaA__ADN26060

SEQ ID NO: 111328 - RNA, 1410 nt, Artificial Sequence; identical to SEQ ID NO: 108250
  derived and/or modified sequence opt2 from neuraminidase__InfluenzaA__ADN26061

SEQ ID NO: 111329 - RNA, 1410 nt, Artificial Sequence; identical to SEQ ID NO: 108250
  derived and/or modified sequence opt2 from neuraminidase__InfluenzaA__ADN26063

SEQ ID NO: 111330 - RNA, 1410 nt, Artificial Sequence; identical to SEQ ID NO: 108250
  derived and/or modified sequence opt2 from neuraminidase__InfluenzaA__ADN26064

SEQ ID NO: 111331 - RNA, 1410 nt, Artificial Sequence; identical to SEQ ID NO: 109323
  derived and/or modified sequence opt2 from neuraminidase__InfluenzaA__ADN26065

SEQ ID NO: 111332 - RNA, 1410 nt, Artificial Sequence; identical to SEQ ID NO: 108250
  derived and/or modified sequence opt2 from neuraminidase__InfluenzaA__ADN26066

SEQ ID NO: 111333 - RNA, 1410 nt, Artificial Sequence; identical to SEQ ID NO: 108250
  derived and/or modified sequence opt2 from neuraminidase__InfluenzaA__ADN26067

SEQ ID NO: 111334 - RNA, 1410 nt, Artificial Sequence; identical to SEQ ID NO: 108250
  derived and/or modified sequence opt2 from neuraminidase__InfluenzaA__ADN26069

SEQ ID NO: 111335 - RNA, 1410 nt, Artificial Sequence; identical to SEQ ID NO: 108250
  derived and/or modified sequence opt2 from neuraminidase__InfluenzaA__ADN26070

SEQ ID NO: 111336 - RNA, 1410 nt, Artificial Sequence; identical to SEQ ID NO: 108250
  derived and/or modified sequence opt2 from neuraminidase__InfluenzaA__ADN26072

SEQ ID NO: 111337 - RNA, 1410 nt, Artificial Sequence; identical to SEQ ID NO: 108250
  derived and/or modified sequence opt2 from neuraminidase__InfluenzaA__ADN26073

SEQ ID NO: 111338 - RNA, 1410 nt, Artificial Sequence; identical to SEQ ID NO: 108250
  derived and/or modified sequence opt2 from neuraminidase__InfluenzaA__ADN26075

SEQ ID NO: 111339 - RNA, 1410 nt, Artificial Sequence; identical to SEQ ID NO: 108250
  derived and/or modified sequence opt2 from neuraminidase__InfluenzaA__ADN26076

SEQ ID NO: 111340 - RNA, 1410 nt, Artificial Sequence; identical to SEQ ID NO: 108250
  derived and/or modified sequence opt2 from neuraminidase__InfluenzaA__ADN26077

SEQ ID NO: 111341 - RNA, 1410 nt, Artificial Sequence; identical to SEQ ID NO: 108250
  derived and/or modified sequence opt2 from neuraminidase__InfluenzaA__ADN26078

SEQ ID NO: 111342 - RNA, 1410 nt, Artificial Sequence; identical to SEQ ID NO: 108250
  derived and/or modified sequence opt2 from neuraminidase__InfluenzaA__ADN26079

SEQ ID NO: 111343 - RNA, 1410 nt, Artificial Sequence; identical to SEQ ID NO: 108250
  derived and/or modified sequence opt2 from neuraminidase__InfluenzaA__ADN26080

SEQ ID NO: 111344 - RNA, 1410 nt, Artificial Sequence; identical to SEQ ID NO: 108250
  derived and/or modified sequence opt2 from neuraminidase__InfluenzaA__ADN26081

SEQ ID NO: 111345 - RNA, 1410 nt, Artificial Sequence; identical to SEQ ID NO: 108250
  derived and/or modified sequence opt2 from neuraminidase__InfluenzaA__ADN26082

SEQ ID NO: 111346 - RNA, 1410 nt, Artificial Sequence; identical to SEQ ID NO: 108250
  derived and/or modified sequence opt2 from neuraminidase__InfluenzaA__ADN26083

SEQ ID NO: 111347 - RNA, 1410 nt, Artificial Sequence; identical to SEQ ID NO: 110152
  derived and/or modified sequence opt2 from neuraminidase__InfluenzaA__ADN26084

SEQ ID NO: 111348 - RNA, 1410 nt, Artificial Sequence; identical to SEQ ID NO: 108250
  derived and/or modified sequence opt2 from neuraminidase__InfluenzaA__ADN26085

SEQ ID NO: 111349 - RNA, 1410 nt, Artificial Sequence; identical to SEQ ID NO: 108250
  derived and/or modified sequence opt2 from neuraminidase__InfluenzaA__ADN26086

SEQ ID NO: 111350 - RNA, 1410 nt, Artificial Sequence; identical to SEQ ID NO: 108250
  derived and/or modified sequence opt2 from neuraminidase__InfluenzaA__ADN26087

SEQ ID NO: 111351 - RNA, 1410 nt, Artificial Sequence; identical to SEQ ID NO: 108250
  derived and/or modified sequence opt2 from neuraminidase__InfluenzaA__ADN26088

SEQ ID NO: 111352 - RNA, 1410 nt, Artificial Sequence; identical to SEQ ID NO: 108250
  derived and/or modified sequence opt2 from neuraminidase__InfluenzaA__ADN26090

SEQ ID NO: 111353 - RNA, 1410 nt, Artificial Sequence; identical to SEQ ID NO: 108250
  derived and/or modified sequence opt2 from neuraminidase__InfluenzaA__ADN26091

SEQ ID NO: 111354 - RNA, 1410 nt, Artificial Sequence; identical to SEQ ID NO: 108250
  derived and/or modified sequence opt2 from neuraminidase__InfluenzaA__ADN26092

SEQ ID NO: 111355 - RNA, 1410 nt, Artificial Sequence; identical to SEQ ID NO: 108250
  derived and/or modified sequence opt2 from neuraminidase__InfluenzaA__ADN26093

SEQ ID NO: 111356 - RNA, 1410 nt, Artificial Sequence
  derived and/or modified sequence opt2 from neuraminidase__InfluenzaA__ADN26094
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaaggacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111357 - RNA, 1410 nt, Artificial Sequence; identical to SEQ ID NO: 110152
  derived and/or modified sequence opt2 from neuraminidase__InfluenzaA__ADN26095

SEQ ID NO: 111358 - RNA, 1410 nt, Artificial Sequence
  derived and/or modified sequence opt2 from neuraminidase__InfluenzaA__ADN26096
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaagaacaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111359 - RNA, 1410 nt, Artificial Sequence; identical to SEQ ID NO: 108250
  derived and/or modified sequence opt2 from neuraminidase__InfluenzaA__ADN26097

SEQ ID NO: 111360 - RNA, 1410 nt, Artificial Sequence; identical to SEQ ID NO: 108250
  derived and/or modified sequence opt2 from neuraminidase__InfluenzaA__ADN26098

SEQ ID NO: 111361 - RNA, 1410 nt, Artificial Sequence; identical to SEQ ID NO: 108250
  derived and/or modified sequence opt2 from neuraminidase__InfluenzaA__ADN26099

SEQ ID NO: 111362 - RNA, 1410 nt, Artificial Sequence; identical to SEQ ID NO: 108250
  derived and/or modified sequence opt2 from neuraminidase__InfluenzaA__ADN26100

SEQ ID NO: 111363 - RNA, 1410 nt, Artificial Sequence; identical to SEQ ID NO: 108250
  derived and/or modified sequence opt2 from neuraminidase__InfluenzaA__ADN26101

SEQ ID NO: 111364 - RNA, 1410 nt, Artificial Sequence
  derived and/or modified sequence opt2 from neuraminidase__InfluenzaA__ADN26102
augaaccccaaccagaagaucaucaccaucggcuccgucugcaugaccaucggcauggccaaccucauccuccagaucggcaacaucaucuccaucuggaucucccaccucauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacuccaucuggaccuccggcuccuccaucuccuucugcggcgucaacuccgacaccgucggcugguccuggcccgacggcgccgagcuccccuucaccaucgacaaguga

SEQ ID NO: 111365 - RNA, 1410 nt, Artificial Sequence; identical to SEQ ID NO: 108250
  derived and/or modified sequence opt2 from neuraminidase__InfluenzaA__ADN26103

SEQ ID NO: 111366 - RNA, 1410 nt, Artificial Sequence; identical to SEQ ID NO: 108250
  derived and/or modified sequence opt2 from neuraminidase__InfluenzaA__ADN26104

SEQ ID NO: 111367 - RNA, 1410 nt, Artificial Sequence; identical to SEQ ID NO: 108250
  derived and/or modified sequence opt2 from neuraminidase__InfluenzaA__ADN26105

SEQ ID NO: 111368 - RNA, 1410 nt, Artificial Sequence; identical to SEQ ID NO: 108250
  derived and/or modified sequence opt2 from neuraminidase__InfluenzaA__ADN26106

SEQ ID NO: 111369 - RNA, 1410 nt, Artificial Sequence; identical to SEQ ID NO: 110152
  derived and/or modified sequence opt2 from neuraminidase__InfluenzaA__ADN26107

SEQ ID NO: 111370 - RNA, 1410 nt, Artificial Sequence; identical to SEQ ID NO: 110152
  derived and/or modified sequence opt2 from neuraminidase__InfluenzaA__ADN26108

SEQ ID NO: 111371 - RNA, 1410 nt, Artificial Sequence; identical to SEQ ID NO: 108250
  derived and/or modified sequence opt2 from neuraminidase__InfluenzaA__ADN26109

SEQ ID NO: 111372 - RNA, 1410 nt, Artificial Sequence; identical to SEQ ID NO: 109224
  derived and/or modified sequence opt2 from neuraminidase__InfluenzaA__ADN26110

SEQ ID NO: 111373 - RNA, 1410 nt, Artificial Sequence; identical to SEQ ID NO: 110152
  derived and/or modified sequence opt2 from neuraminidase__InfluenzaA__ADN26111

SEQ ID NO: 111374 - RNA, 1410 nt, Artificial Sequence; identical to SEQ ID NO: 109224
  derived and/or modified sequence opt2 from neuraminidase__InfluenzaA__ADN26112

SEQ ID NO: 111375 - RNA, 1410 nt, Artificial Sequence; identical to SEQ ID NO: 110152
  derived and/or modified sequence opt2 from neuraminidase__InfluenzaA__ADN26113

SEQ ID NO: 111376 - RNA, 1410 nt, Artificial Sequence
  derived and/or modified sequence opt2 from neuraminidase__InfluenzaA__ADN26114
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucaacaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111377 - RNA, 1410 nt, Artificial Sequence; identical to SEQ ID NO: 108250
  derived and/or modified sequence opt2 from neuraminidase__InfluenzaA__ADN26115

SEQ ID NO: 111378 - RNA, 1410 nt, Artificial Sequence
  derived and/or modified sequence opt2 from neuraminidase__InfluenzaA__ADN26116
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucacccgccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111379 - RNA, 1410 nt, Artificial Sequence; identical to SEQ ID NO: 110152
  derived and/or modified sequence opt2 from neuraminidase__InfluenzaA__ADN26117

SEQ ID NO: 111380 - RNA, 1410 nt, Artificial Sequence; identical to SEQ ID NO: 110152
  derived and/or modified sequence opt2 from neuraminidase__InfluenzaA__ADN26118

SEQ ID NO: 111381 - RNA, 1410 nt, Artificial Sequence; identical to SEQ ID NO: 108250
  derived and/or modified sequence opt2 from neuraminidase__InfluenzaA__ADN26119

SEQ ID NO: 111382 - RNA, 1410 nt, Artificial Sequence; identical to SEQ ID NO: 109224
  derived and/or modified sequence opt2 from neuraminidase__InfluenzaA__ADN26120

SEQ ID NO: 111383 - RNA, 1410 nt, Artificial Sequence; identical to SEQ ID NO: 110152
  derived and/or modified sequence opt2 from neuraminidase__InfluenzaA__ADN26121

SEQ ID NO: 111384 - RNA, 1410 nt, Artificial Sequence; identical to SEQ ID NO: 108250
  derived and/or modified sequence opt2 from neuraminidase__InfluenzaA__ADN26122

SEQ ID NO: 111385 - RNA, 1410 nt, Artificial Sequence; identical to SEQ ID NO: 108250
  derived and/or modified sequence opt2 from neuraminidase__InfluenzaA__ADN26123

SEQ ID NO: 111386 - RNA, 1410 nt, Artificial Sequence; identical to SEQ ID NO: 108250
  derived and/or modified sequence opt2 from neuraminidase__InfluenzaA__ADN26124

SEQ ID NO: 111387 - RNA, 1410 nt, Artificial Sequence; identical to SEQ ID NO: 109224
  derived and/or modified sequence opt2 from neuraminidase__InfluenzaA__ADN26125

SEQ ID NO: 111388 - RNA, 1410 nt, Artificial Sequence; identical to SEQ ID NO: 109224
  derived and/or modified sequence opt2 from neuraminidase__InfluenzaA__ADN26126

SEQ ID NO: 111389 - RNA, 1410 nt, Artificial Sequence; identical to SEQ ID NO: 109015
  derived and/or modified sequence opt2 from neuraminidase__InfluenzaA__ADN26127

SEQ ID NO: 111390 - RNA, 1410 nt, Artificial Sequence; identical to SEQ ID NO: 108250
  derived and/or modified sequence opt2 from neuraminidase__InfluenzaA__ADN26128

SEQ ID NO: 111391 - RNA, 1410 nt, Artificial Sequence; identical to SEQ ID NO: 109224
  derived and/or modified sequence opt2 from neuraminidase__InfluenzaA__ADN26129

SEQ ID NO: 111392 - RNA, 1410 nt, Artificial Sequence; identical to SEQ ID NO: 110152
  derived and/or modified sequence opt2 from neuraminidase__InfluenzaA__ADN26130

SEQ ID NO: 111393 - RNA, 1410 nt, Artificial Sequence
  derived and/or modified sequence opt2 from neuraminidase__InfluenzaA__ADN26131
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucucccucugcggcgucaacuccgacaccgucggcugguccuggcccgacggcgccgagcuccccuucaccaucgacaaguga

SEQ ID NO: 111394 - RNA, 1410 nt, Artificial Sequence; identical to SEQ ID NO: 110152
  derived and/or modified sequence opt2 from neuraminidase__InfluenzaA__ADN26132

SEQ ID NO: 111395 - RNA, 1410 nt, Artificial Sequence; identical to SEQ ID NO: 109224
  derived and/or modified sequence opt2 from neuraminidase__InfluenzaA__ADN26134

SEQ ID NO: 111396 - RNA, 1410 nt, Artificial Sequence; identical to SEQ ID NO: 108250
  derived and/or modified sequence opt2 from neuraminidase__InfluenzaA__ADN26135

SEQ ID NO: 111397 - RNA, 1410 nt, Artificial Sequence; identical to SEQ ID NO: 108250
  derived and/or modified sequence opt2 from neuraminidase__InfluenzaA__ADN26136

SEQ ID NO: 111398 - RNA, 1410 nt, Artificial Sequence; identical to SEQ ID NO: 108250
  derived and/or modified sequence opt2 from neuraminidase__InfluenzaA__ADN26137

SEQ ID NO: 111399 - RNA, 1410 nt, Artificial Sequence; identical to SEQ ID NO: 110152
  derived and/or modified sequence opt2 from neuraminidase__InfluenzaA__ADN26138

SEQ ID NO: 111400 - RNA, 1410 nt, Artificial Sequence; identical to SEQ ID NO: 109224
  derived and/or modified sequence opt2 from neuraminidase__InfluenzaA__ADN26140

SEQ ID NO: 111401 - RNA, 1410 nt, Artificial Sequence
  derived and/or modified sequence opt2 from neuraminidase__InfluenzaA__ADN26141
augaaccccaaccagaagaucaucaccaucggcuccgucugcaugaccaucggcauggccaaccucauccuccagaucggcaacaucaucuccaucuggaucucccacuccauccagcucggcaaccagaaccgcaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111402 - RNA, 1410 nt, Artificial Sequence
  derived and/or modified sequence opt2 from neuraminidase__InfluenzaA__ADN26142
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaacaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111403 - RNA, 1410 nt, Artificial Sequence; identical to SEQ ID NO: 108250
  derived and/or modified sequence opt2 from neuraminidase__InfluenzaA__ADN26143

SEQ ID NO: 111404 - RNA, 1410 nt, Artificial Sequence; identical to SEQ ID NO: 110152
  derived and/or modified sequence opt2 from neuraminidase__InfluenzaA__ADN26144

SEQ ID NO: 111405 - RNA, 1410 nt, Artificial Sequence; identical to SEQ ID NO: 110152
  derived and/or modified sequence opt2 from neuraminidase__InfluenzaA__ADN26145

SEQ ID NO: 111406 - RNA, 1410 nt, Artificial Sequence; identical to SEQ ID NO: 108250
  derived and/or modified sequence opt2 from neuraminidase__InfluenzaA__ADN26146

SEQ ID NO: 111407 - RNA, 1410 nt, Artificial Sequence; identical to SEQ ID NO: 110152
  derived and/or modified sequence opt2 from neuraminidase__InfluenzaA__ADN26147

SEQ ID NO: 111408 - RNA, 1410 nt, Artificial Sequence; identical to SEQ ID NO: 108250
  derived and/or modified sequence opt2 from neuraminidase__InfluenzaA__ADN26148

SEQ ID NO: 111409 - RNA, 1410 nt, Artificial Sequence; identical to SEQ ID NO: 110152
  derived and/or modified sequence opt2 from neuraminidase__InfluenzaA__ADN26149

SEQ ID NO: 111410 - RNA, 1410 nt, Artificial Sequence
  derived and/or modified sequence opt2 from neuraminidase__InfluenzaA__ADN26150
augaaccccaaccagaagaucaucaccaucggcuccgucugcaugaccaucggcauggccucccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111411 - RNA, 1410 nt, Artificial Sequence; identical to SEQ ID NO: 109224
  derived and/or modified sequence opt2 from neuraminidase__InfluenzaA__ADN26151

SEQ ID NO: 111412 - RNA, 1410 nt, Artificial Sequence
  derived and/or modified sequence opt2 from neuraminidase__InfluenzaA__ADN26152
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggacccgcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111413 - RNA, 1410 nt, Artificial Sequence; identical to SEQ ID NO: 110152
  derived and/or modified sequence opt2 from neuraminidase__InfluenzaA__ADN26153

SEQ ID NO: 111414 - RNA, 1410 nt, Artificial Sequence; identical to SEQ ID NO: 108833
  derived and/or modified sequence opt2 from neuraminidase__InfluenzaA__ADN26154

SEQ ID NO: 111415 - RNA, 1410 nt, Artificial Sequence; identical to SEQ ID NO: 108250
  derived and/or modified sequence opt2 from neuraminidase__InfluenzaA__ADN26155

SEQ ID NO: 111416 - RNA, 1410 nt, Artificial Sequence; identical to SEQ ID NO: 109224
  derived and/or modified sequence opt2 from neuraminidase__InfluenzaA__ADN26157

SEQ ID NO: 111417 - RNA, 1410 nt, Artificial Sequence; identical to SEQ ID NO: 108250
  derived and/or modified sequence opt2 from neuraminidase__InfluenzaA__ADN26159

SEQ ID NO: 111418 - RNA, 1410 nt, Artificial Sequence; identical to SEQ ID NO: 108250
  derived and/or modified sequence opt2 from neuraminidase__InfluenzaA__ADN26161

SEQ ID NO: 111419 - RNA, 1410 nt, Artificial Sequence
  derived and/or modified sequence opt2 from neuraminidase__InfluenzaA__ADN26162
augaaccccaaccagaagaucaucaccaucuccuccgucugcaugaccgucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111420 - RNA, 1410 nt, Artificial Sequence
  derived and/or modified sequence opt2 from neuraminidase__InfluenzaA__ADN26163
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaucaucgacaaguga

SEQ ID NO: 111421 - RNA, 1410 nt, Artificial Sequence
  derived and/or modified sequence opt2 from neuraminidase__InfluenzaA__ADN26164
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugccucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111422 - RNA, 1410 nt, Artificial Sequence; identical to SEQ ID NO: 110207
  derived and/or modified sequence opt2 from neuraminidase__InfluenzaA__ADN26168

SEQ ID NO: 111423 - RNA, 1410 nt, Artificial Sequence; identical to SEQ ID NO: 109473
  derived and/or modified sequence opt2 from neuraminidase__InfluenzaA__ADN26178

SEQ ID NO: 111424 - RNA, 1410 nt, Artificial Sequence; identical to SEQ ID NO: 108250
  derived and/or modified sequence opt2 from neuraminidase__InfluenzaA__ADN26868

SEQ ID NO: 111425 - RNA, 1410 nt, Artificial Sequence; identical to SEQ ID NO: 108250
  derived and/or modified sequence opt2 from neuraminidase__InfluenzaA__ADN26869

SEQ ID NO: 111426 - RNA, 1410 nt, Artificial Sequence; identical to SEQ ID NO: 108250
  derived and/or modified sequence opt2 from neuraminidase__InfluenzaA__ADN26870

SEQ ID NO: 111427 - RNA, 1410 nt, Artificial Sequence
  derived and/or modified sequence opt2 from neuraminidase__InfluenzaA__ADN26871
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccuacaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111428 - RNA, 1410 nt, Artificial Sequence
  derived and/or modified sequence opt2 from neuraminidase__InfluenzaA__ADN26872
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccucuccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111429 - RNA, 1410 nt, Artificial Sequence; identical to SEQ ID NO: 108250
  derived and/or modified sequence opt2 from neuraminidase__InfluenzaA__ADN26873

SEQ ID NO: 111430 - RNA, 1410 nt, Artificial Sequence; identical to SEQ ID NO: 108250
  derived and/or modified sequence opt2 from neuraminidase__InfluenzaA__ADN26874

SEQ ID NO: 111431 - RNA, 1410 nt, Artificial Sequence; identical to SEQ ID NO: 108250
  derived and/or modified sequence opt2 from neuraminidase__InfluenzaA__ADN26875

SEQ ID NO: 111432 - RNA, 1410 nt, Artificial Sequence; identical to SEQ ID NO: 108250
  derived and/or modified sequence opt2 from neuraminidase__InfluenzaA__ADN26876

SEQ ID NO: 111433 - RNA, 1410 nt, Artificial Sequence; identical to SEQ ID NO: 108250
  derived and/or modified sequence opt2 from neuraminidase__InfluenzaA__ADN26877

SEQ ID NO: 111434 - RNA, 1410 nt, Artificial Sequence; identical to SEQ ID NO: 108250
  derived and/or modified sequence opt2 from neuraminidase__InfluenzaA__ADN26878

SEQ ID NO: 111435 - RNA, 1410 nt, Artificial Sequence; identical to SEQ ID NO: 109387
  derived and/or modified sequence opt2 from neuraminidase__InfluenzaA__ADN26879

SEQ ID NO: 111436 - RNA, 1410 nt, Artificial Sequence; identical to SEQ ID NO: 108250
  derived and/or modified sequence opt2 from neuraminidase__InfluenzaA__ADN26880

SEQ ID NO: 111437 - RNA, 1410 nt, Artificial Sequence; identical to SEQ ID NO: 108250
  derived and/or modified sequence opt2 from neuraminidase__InfluenzaA__ADN26881

SEQ ID NO: 111438 - RNA, 1410 nt, Artificial Sequence; identical to SEQ ID NO: 108250
  derived and/or modified sequence opt2 from neuraminidase__InfluenzaA__ADN26882

SEQ ID NO: 111439 - RNA, 1410 nt, Artificial Sequence; identical to SEQ ID NO: 108250
  derived and/or modified sequence opt2 from neuraminidase__InfluenzaA__ADN26883

SEQ ID NO: 111440 - RNA, 1413 nt, Artificial Sequence
  derived and/or modified sequence opt2 from neuraminidase__InfluenzaA__ADN89064
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgccgcggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111441 - RNA, 1413 nt, Artificial Sequence; identical to SEQ ID NO: 108973
  derived and/or modified sequence opt2 from neuraminidase__InfluenzaA__ADN89075

SEQ ID NO: 111442 - RNA, 1413 nt, Artificial Sequence
  derived and/or modified sequence opt2 from neuraminidase__InfluenzaA__ADN89086
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaagaccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111443 - RNA, 1413 nt, Artificial Sequence; identical to SEQ ID NO: 108973
  derived and/or modified sequence opt2 from neuraminidase__InfluenzaA__ADN89097

SEQ ID NO: 111444 - RNA, 1413 nt, Artificial Sequence
  derived and/or modified sequence opt2 from neuraminidase__InfluenzaA__ADN89108
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucuccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111445 - RNA, 1413 nt, Artificial Sequence
  derived and/or modified sequence opt2 from neuraminidase__InfluenzaA__ADN89119
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcacccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111446 - RNA, 1413 nt, Artificial Sequence
  derived and/or modified sequence opt2 from neuraminidase__InfluenzaA__ADN89130
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaacuucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 111447 - RNA, 1413 nt, Artificial Sequence; identical to SEQ ID NO: 111444
  derived and/or modified sequence opt2 from neuraminidase__InfluenzaA__ADN89141

SEQ ID NO: 111448 - RNA, 1413 nt, Artificial Sequence
  derived and/or modified sequence opt2 from neuraminidase__InfluenzaA__ADN89152
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccaucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111449 - RNA, 1413 nt, Artificial Sequence
  derived and/or modified sequence opt2 from neuraminidase__InfluenzaA__ADN89163
augaaccccaaccagcgcaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111450 - RNA, 1413 nt, Artificial Sequence; identical to SEQ ID NO: 110442
  derived and/or modified sequence opt2 from neuraminidase__InfluenzaA__ADN89174

SEQ ID NO: 111451 - RNA, 1413 nt, Artificial Sequence; identical to SEQ ID NO: 111444
  derived and/or modified sequence opt2 from neuraminidase__InfluenzaA__ADN89185

SEQ ID NO: 111452 - RNA, 1413 nt, Artificial Sequence
  derived and/or modified sequence opt2 from neuraminidase__InfluenzaA__ADN89196
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaugggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucucccucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111453 - RNA, 1413 nt, Artificial Sequence; identical to SEQ ID NO: 111452
  derived and/or modified sequence opt2 from neuraminidase__InfluenzaA__ADN89207

SEQ ID NO: 111454 - RNA, 1413 nt, Artificial Sequence
  derived and/or modified sequence opt2 from neuraminidase__InfluenzaA__ADN89218
augaaccccaaccagaagaucaucaccaucggcuccaucuccaucgccaucggcaucaucucccucaugcuccagaucggcaacaucaucuccaucugggccucccacuccauccagcccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 111455 - RNA, 1413 nt, Artificial Sequence
  derived and/or modified sequence opt2 from neuraminidase__InfluenzaA__ADN89229
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaccaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111456 - RNA, 1413 nt, Artificial Sequence
  derived and/or modified sequence opt2 from neuraminidase__InfluenzaA__ADN89240
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 111457 - RNA, 1413 nt, Artificial Sequence; identical to SEQ ID NO: 108973
  derived and/or modified sequence opt2 from neuraminidase__InfluenzaA__ADN89251

SEQ ID NO: 111458 - RNA, 1413 nt, Artificial Sequence; identical to SEQ ID NO: 108973
  derived and/or modified sequence opt2 from neuraminidase__InfluenzaA__ADN89262

SEQ ID NO: 111459 - RNA, 1413 nt, Artificial Sequence; identical to SEQ ID NO: 108973
  derived and/or modified sequence opt2 from neuraminidase__InfluenzaA__ADN89273

SEQ ID NO: 111460 - RNA, 1413 nt, Artificial Sequence; identical to SEQ ID NO: 108973
  derived and/or modified sequence opt2 from neuraminidase__InfluenzaA__ADN89284

SEQ ID NO: 111461 - RNA, 1413 nt, Artificial Sequence; identical to SEQ ID NO: 108973
  derived and/or modified sequence opt2 from neuraminidase__InfluenzaA__ADN89295

SEQ ID NO: 111462 - RNA, 1413 nt, Artificial Sequence; identical to SEQ ID NO: 108973
  derived and/or modified sequence opt2 from neuraminidase__InfluenzaA__ADN89306

SEQ ID NO: 111463 - RNA, 1413 nt, Artificial Sequence
  derived and/or modified sequence opt2 from neuraminidase__InfluenzaA__ADN89317
augaaccccaaccagcgcaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacuccaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 111464 - RNA, 1413 nt, Artificial Sequence
  derived and/or modified sequence opt2 from neuraminidase__InfluenzaA__ADN89328
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucugggccuccggcuccuccaucuccuucugcggcgucaacuccgacaccgccaacugguccuggcccgacggcgccgagcuccccuucaccaucgacaaguga

SEQ ID NO: 111465 - RNA, 1413 nt, Artificial Sequence; identical to SEQ ID NO: 111449
  derived and/or modified sequence opt2 from neuraminidase__InfluenzaA__ADN89339

SEQ ID NO: 111466 - RNA, 1413 nt, Artificial Sequence; identical to SEQ ID NO: 111455
  derived and/or modified sequence opt2 from neuraminidase__InfluenzaA__ADN89350

SEQ ID NO: 111467 - RNA, 1413 nt, Artificial Sequence
  derived and/or modified sequence opt2 from neuraminidase__InfluenzaA__ADN89361
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucaucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111468 - RNA, 1413 nt, Artificial Sequence
  derived and/or modified sequence opt2 from neuraminidase__InfluenzaA__ADN89372
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacaucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111469 - RNA, 1413 nt, Artificial Sequence; identical to SEQ ID NO: 111444
  derived and/or modified sequence opt2 from neuraminidase__InfluenzaA__ADN89383

SEQ ID NO: 111470 - RNA, 1413 nt, Artificial Sequence
  derived and/or modified sequence opt2 from neuraminidase__InfluenzaA__ADN89405
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaccuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111471 - RNA, 1413 nt, Artificial Sequence
  derived and/or modified sequence opt2 from neuraminidase__InfluenzaA__ADN89416
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcguccucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 111472 - RNA, 1413 nt, Artificial Sequence
  derived and/or modified sequence opt2 from neuraminidase__InfluenzaA__ADN89427
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacgccgccgacugguccuggcccgacggcgccgagcuccccuucaccaucgacaaguga

SEQ ID NO: 111473 - RNA, 1413 nt, Artificial Sequence; identical to SEQ ID NO: 108973
  derived and/or modified sequence opt2 from neuraminidase__InfluenzaA__ADN89438

SEQ ID NO: 111474 - RNA, 1413 nt, Artificial Sequence
  derived and/or modified sequence opt2 from neuraminidase__InfluenzaA__ADN89449
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagcccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111475 - RNA, 1413 nt, Artificial Sequence; identical to SEQ ID NO: 110442
  derived and/or modified sequence opt2 from neuraminidase__InfluenzaA__ADN89460

SEQ ID NO: 111476 - RNA, 1413 nt, Artificial Sequence; identical to SEQ ID NO: 108973
  derived and/or modified sequence opt2 from neuraminidase__InfluenzaA__ADN89482

SEQ ID NO: 111477 - RNA, 1413 nt, Artificial Sequence
  derived and/or modified sequence opt2 from neuraminidase__InfluenzaA__ADN89493
augaaccccaaccagaagaucaucaccaucggcuccaucuccaucgccaucggcaucaucucccucaugcuccagaucggcaacaucaucuccaucugggccucccacuccauccagaccgagucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaugggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111478 - RNA, 1413 nt, Artificial Sequence; identical to SEQ ID NO: 108973
  derived and/or modified sequence opt2 from neuraminidase__InfluenzaA__ADN89504

SEQ ID NO: 111479 - RNA, 1413 nt, Artificial Sequence
  derived and/or modified sequence opt2 from neuraminidase__InfluenzaA__ADN89515
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucaccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111480 - RNA, 1413 nt, Artificial Sequence; identical to SEQ ID NO: 108973
  derived and/or modified sequence opt2 from neuraminidase__InfluenzaA__ADN89526

SEQ ID NO: 111481 - RNA, 1413 nt, Artificial Sequence; identical to SEQ ID NO: 111444
  derived and/or modified sequence opt2 from neuraminidase__InfluenzaA__ADN89537

SEQ ID NO: 111482 - RNA, 1413 nt, Artificial Sequence; identical to SEQ ID NO: 108973
  derived and/or modified sequence opt2 from neuraminidase__InfluenzaA__ADN89548

SEQ ID NO: 111483 - RNA, 1413 nt, Artificial Sequence; identical to SEQ ID NO: 108973
  derived and/or modified sequence opt2 from neuraminidase__InfluenzaA__ADN89570

SEQ ID NO: 111484 - RNA, 1413 nt, Artificial Sequence
  derived and/or modified sequence opt2 from neuraminidase__InfluenzaA__ADN89581
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaagaccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaccgccaacugguccuggcccgacggcgccgagcuccccuucaccaucgacaaguga

SEQ ID NO: 111485 - RNA, 1413 nt, Artificial Sequence; identical to SEQ ID NO: 110442
  derived and/or modified sequence opt2 from neuraminidase__InfluenzaA__ADN89592

SEQ ID NO: 111486 - RNA, 1413 nt, Artificial Sequence; identical to SEQ ID NO: 110442
  derived and/or modified sequence opt2 from neuraminidase__InfluenzaA__ADN89603

SEQ ID NO: 111487 - RNA, 1413 nt, Artificial Sequence; identical to SEQ ID NO: 111452
  derived and/or modified sequence opt2 from neuraminidase__InfluenzaA__ADN89614

SEQ ID NO: 111488 - RNA, 1413 nt, Artificial Sequence; identical to SEQ ID NO: 111471
  derived and/or modified sequence opt2 from neuraminidase__InfluenzaA__ADN89625

SEQ ID NO: 111489 - RNA, 1413 nt, Artificial Sequence; identical to SEQ ID NO: 108973
  derived and/or modified sequence opt2 from neuraminidase__InfluenzaA__ADN89636

SEQ ID NO: 111490 - RNA, 1413 nt, Artificial Sequence; identical to SEQ ID NO: 108973
  derived and/or modified sequence opt2 from neuraminidase__InfluenzaA__ADN89647

SEQ ID NO: 111491 - RNA, 1413 nt, Artificial Sequence; identical to SEQ ID NO: 108973
  derived and/or modified sequence opt2 from neuraminidase__InfluenzaA__ADN89658

SEQ ID NO: 111492 - RNA, 1413 nt, Artificial Sequence; identical to SEQ ID NO: 110442
  derived and/or modified sequence opt2 from neuraminidase__InfluenzaA__ADN89669

SEQ ID NO: 111493 - RNA, 1413 nt, Artificial Sequence; identical to SEQ ID NO: 108973
  derived and/or modified sequence opt2 from neuraminidase__InfluenzaA__ADN89680

SEQ ID NO: 111494 - RNA, 1413 nt, Artificial Sequence; identical to SEQ ID NO: 108973
  derived and/or modified sequence opt2 from neuraminidase__InfluenzaA__ADN89691

SEQ ID NO: 111495 - RNA, 1413 nt, Artificial Sequence; identical to SEQ ID NO: 111471
  derived and/or modified sequence opt2 from neuraminidase__InfluenzaA__ADN89702

SEQ ID NO: 111496 - RNA, 1413 nt, Artificial Sequence; identical to SEQ ID NO: 108973
  derived and/or modified sequence opt2 from neuraminidase__InfluenzaA__ADN89713

SEQ ID NO: 111497 - RNA, 1413 nt, Artificial Sequence; identical to SEQ ID NO: 108973
  derived and/or modified sequence opt2 from neuraminidase__InfluenzaA__ADN89724

SEQ ID NO: 111498 - RNA, 1413 nt, Artificial Sequence; identical to SEQ ID NO: 108973
  derived and/or modified sequence opt2 from neuraminidase__InfluenzaA__ADN89735

SEQ ID NO: 111499 - RNA, 1413 nt, Artificial Sequence; identical to SEQ ID NO: 108973
  derived and/or modified sequence opt2 from neuraminidase__InfluenzaA__ADN89746

SEQ ID NO: 111500 - RNA, 1413 nt, Artificial Sequence; identical to SEQ ID NO: 108973
  derived and/or modified sequence opt2 from neuraminidase__InfluenzaA__ADN89757

SEQ ID NO: 111501 - RNA, 1413 nt, Artificial Sequence; identical to SEQ ID NO: 108973
  derived and/or modified sequence opt2 from neuraminidase__InfluenzaA__ADN89768

SEQ ID NO: 111502 - RNA, 1413 nt, Artificial Sequence; identical to SEQ ID NO: 111448
  derived and/or modified sequence opt2 from neuraminidase__InfluenzaA__ADN89779

SEQ ID NO: 111503 - RNA, 1413 nt, Artificial Sequence; identical to SEQ ID NO: 108973
  derived and/or modified sequence opt2 from neuraminidase__InfluenzaA__ADN89790

SEQ ID NO: 111504 - RNA, 1413 nt, Artificial Sequence
  derived and/or modified sequence opt2 from neuraminidase__InfluenzaA__ADN89801
augaaccccaaccagaagaucaucaccaucggcuccaucuccaucgccaucggcaccaucucccucaugcuccagaucggcaacaucaucuccaucugggccucccacuccauccagaccggcucccagaacaacaccggcaucugcaaccagcgcaucaucaccuacaagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111505 - RNA, 1413 nt, Artificial Sequence
  derived and/or modified sequence opt2 from neuraminidase__InfluenzaA__ADN89823
augaaccccaaccagaagaucaucaccaucggcuccaucuccaucgccaucggcaucaucucccucaugcuccagaucggcuccaucaucuccaucugggccucccacuccauccacaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111506 - RNA, 1413 nt, Artificial Sequence; identical to SEQ ID NO: 110442
  derived and/or modified sequence opt2 from neuraminidase__InfluenzaA__ADN89834

SEQ ID NO: 111507 - RNA, 1413 nt, Artificial Sequence; identical to SEQ ID NO: 111444
  derived and/or modified sequence opt2 from neuraminidase__InfluenzaA__ADN89845

SEQ ID NO: 111508 - RNA, 1413 nt, Artificial Sequence; identical to SEQ ID NO: 108973
  derived and/or modified sequence opt2 from neuraminidase__InfluenzaA__ADN89856

SEQ ID NO: 111509 - RNA, 1410 nt, Artificial Sequence; identical to SEQ ID NO: 110922
  derived and/or modified sequence opt2 from neuraminidase__InfluenzaA__ADN89867

SEQ ID NO: 111510 - RNA, 1410 nt, Artificial Sequence; identical to SEQ ID NO: 110922
  derived and/or modified sequence opt2 from neuraminidase__InfluenzaA__ADN89878

SEQ ID NO: 111511 - RNA, 1410 nt, Artificial Sequence; identical to SEQ ID NO: 110922
  derived and/or modified sequence opt2 from neuraminidase__InfluenzaA__ADN89889

SEQ ID NO: 111512 - RNA, 1410 nt, Artificial Sequence; identical to SEQ ID NO: 110922
  derived and/or modified sequence opt2 from neuraminidase__InfluenzaA__ADN89900

SEQ ID NO: 111513 - RNA, 1410 nt, Artificial Sequence; identical to SEQ ID NO: 110922
  derived and/or modified sequence opt2 from neuraminidase__InfluenzaA__ADN89911

SEQ ID NO: 111514 - RNA, 1410 nt, Artificial Sequence
  derived and/or modified sequence opt2 from neuraminidase__InfluenzaA__ADN89922
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaacaucaugcccaucuga

SEQ ID NO: 111515 - RNA, 1410 nt, Artificial Sequence; identical to SEQ ID NO: 110922
  derived and/or modified sequence opt2 from neuraminidase__InfluenzaA__ADN89933

SEQ ID NO: 111516 - RNA, 1410 nt, Artificial Sequence; identical to SEQ ID NO: 110922
  derived and/or modified sequence opt2 from neuraminidase__InfluenzaA__ADN89955

SEQ ID NO: 111517 - RNA, 1410 nt, Artificial Sequence; identical to SEQ ID NO: 110922
  derived and/or modified sequence opt2 from neuraminidase__InfluenzaA__ADN89966

SEQ ID NO: 111518 - RNA, 1410 nt, Artificial Sequence; identical to SEQ ID NO: 110922
  derived and/or modified sequence opt2 from neuraminidase__InfluenzaA__ADN89977

SEQ ID NO: 111519 - RNA, 1410 nt, Artificial Sequence; identical to SEQ ID NO: 110922
  derived and/or modified sequence opt2 from neuraminidase__InfluenzaA__ADN89988

SEQ ID NO: 111520 - RNA, 1410 nt, Artificial Sequence; identical to SEQ ID NO: 110922
  derived and/or modified sequence opt2 from neuraminidase__InfluenzaA__ADN89999

SEQ ID NO: 111521 - RNA, 1410 nt, Artificial Sequence; identical to SEQ ID NO: 110922
  derived and/or modified sequence opt2 from neuraminidase__InfluenzaA__ADN90010

SEQ ID NO: 111522 - RNA, 1410 nt, Artificial Sequence; identical to SEQ ID NO: 110922
  derived and/or modified sequence opt2 from neuraminidase__InfluenzaA__ADN90021

SEQ ID NO: 111523 - RNA, 1410 nt, Artificial Sequence; identical to SEQ ID NO: 110922
  derived and/or modified sequence opt2 from neuraminidase__InfluenzaA__ADN90032

SEQ ID NO: 111524 - RNA, 1410 nt, Artificial Sequence; identical to SEQ ID NO: 110922
  derived and/or modified sequence opt2 from neuraminidase__InfluenzaA__ADN90043

SEQ ID NO: 111525 - RNA, 1410 nt, Artificial Sequence; identical to SEQ ID NO: 110922
  derived and/or modified sequence opt2 from neuraminidase__InfluenzaA__ADN90054

SEQ ID NO: 111526 - RNA, 1410 nt, Artificial Sequence; identical to SEQ ID NO: 110922
  derived and/or modified sequence opt2 from neuraminidase__InfluenzaA__ADN90065

SEQ ID NO: 111527 - RNA, 1410 nt, Artificial Sequence; identical to SEQ ID NO: 110922
  derived and/or modified sequence opt2 from neuraminidase__InfluenzaA__ADN90076

SEQ ID NO: 111528 - RNA, 1410 nt, Artificial Sequence; identical to SEQ ID NO: 110922
  derived and/or modified sequence opt2 from neuraminidase__InfluenzaA__ADN90087

SEQ ID NO: 111529 - RNA, 1410 nt, Artificial Sequence; identical to SEQ ID NO: 110922
  derived and/or modified sequence opt2 from neuraminidase__InfluenzaA__ADN90098

SEQ ID NO: 111530 - RNA, 1410 nt, Artificial Sequence; identical to SEQ ID NO: 110922
  derived and/or modified sequence opt2 from neuraminidase__InfluenzaA__ADN90109

SEQ ID NO: 111531 - RNA, 1410 nt, Artificial Sequence; identical to SEQ ID NO: 110922
  derived and/or modified sequence opt2 from neuraminidase__InfluenzaA__ADN90120

SEQ ID NO: 111532 - RNA, 1410 nt, Artificial Sequence; identical to SEQ ID NO: 110922
  derived and/or modified sequence opt2 from neuraminidase__InfluenzaA__ADN90131

SEQ ID NO: 111533 - RNA, 1410 nt, Artificial Sequence; identical to SEQ ID NO: 110922
  derived and/or modified sequence opt2 from neuraminidase__InfluenzaA__ADN90142

SEQ ID NO: 111534 - RNA, 1410 nt, Artificial Sequence; identical to SEQ ID NO: 110922
  derived and/or modified sequence opt2 from neuraminidase__InfluenzaA__ADN90153

SEQ ID NO: 111535 - RNA, 1410 nt, Artificial Sequence; identical to SEQ ID NO: 110922
  derived and/or modified sequence opt2 from neuraminidase__InfluenzaA__ADN90164

SEQ ID NO: 111536 - RNA, 1410 nt, Artificial Sequence; identical to SEQ ID NO: 110922
  derived and/or modified sequence opt2 from neuraminidase__InfluenzaA__ADN90186

SEQ ID NO: 111537 - RNA, 1410 nt, Artificial Sequence; identical to SEQ ID NO: 110922
  derived and/or modified sequence opt2 from neuraminidase__InfluenzaA__ADN90197

SEQ ID NO: 111538 - RNA, 1410 nt, Artificial Sequence
  derived and/or modified sequence opt2 from neuraminidase__InfluenzaA__ADN90208
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcuccaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 111539 - RNA, 1410 nt, Artificial Sequence; identical to SEQ ID NO: 110922
  derived and/or modified sequence opt2 from neuraminidase__InfluenzaA__ADN90219

SEQ ID NO: 111540 - RNA, 1410 nt, Artificial Sequence
  derived and/or modified sequence opt2 from neuraminidase__InfluenzaA__ADN92469
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccgagaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111541 - RNA, 1410 nt, Artificial Sequence; identical to SEQ ID NO: 110767
  derived and/or modified sequence opt2 from neuraminidase__InfluenzaA__ADN92480

SEQ ID NO: 111542 - RNA, 1410 nt, Artificial Sequence; identical to SEQ ID NO: 110767
  derived and/or modified sequence opt2 from neuraminidase__InfluenzaA__ADN92491

SEQ ID NO: 111543 - RNA, 1410 nt, Artificial Sequence
  derived and/or modified sequence opt2 from neuraminidase__InfluenzaA__ADN92502
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggcaacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 111544 - RNA, 1410 nt, Artificial Sequence; identical to SEQ ID NO: 108250
  derived and/or modified sequence opt2 from neuraminidase__InfluenzaA__ADN92512

SEQ ID NO: 111545 - RNA, 1410 nt, Artificial Sequence; identical to SEQ ID NO: 108250
  derived and/or modified sequence opt2 from neuraminidase__InfluenzaA__ADN92522

SEQ ID NO: 111546 - RNA, 1410 nt, Artificial Sequence; identical to SEQ ID NO: 108250
  derived and/or modified sequence opt2 from neuraminidase__InfluenzaA__ADN92532

SEQ ID NO: 111547 - RNA, 1410 nt, Artificial Sequence; identical to SEQ ID NO: 108250
  derived and/or modified sequence opt2 from neuraminidase__InfluenzaA__ADN92542

SEQ ID NO: 111548 - RNA, 1410 nt, Artificial Sequence; identical to SEQ ID NO: 108250
  derived and/or modified sequence opt2 from neuraminidase__InfluenzaA__ADN92552

SEQ ID NO: 111549 - RNA, 1410 nt, Artificial Sequence; identical to SEQ ID NO: 108250
  derived and/or modified sequence opt2 from neuraminidase__InfluenzaA__ADO00733

SEQ ID NO: 111550 - RNA, 1410 nt, Artificial Sequence
  derived and/or modified sequence opt2 from neuraminidase__InfluenzaA__ADO00743
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgccaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccauccgccaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111551 - RNA, 1410 nt, Artificial Sequence; identical to SEQ ID NO: 109427
  derived and/or modified sequence opt2 from neuraminidase__InfluenzaA__ADO00753

SEQ ID NO: 111552 - RNA, 1410 nt, Artificial Sequence; identical to SEQ ID NO: 108250
  derived and/or modified sequence opt2 from neuraminidase__InfluenzaA__ADO12146

SEQ ID NO: 111553 - RNA, 1410 nt, Artificial Sequence; identical to SEQ ID NO: 108250
  derived and/or modified sequence opt2 from neuraminidase__InfluenzaA__ADO12156

SEQ ID NO: 111554 - RNA, 1410 nt, Artificial Sequence; identical to SEQ ID NO: 108250
  derived and/or modified sequence opt2 from neuraminidase__InfluenzaA__ADO12166

SEQ ID NO: 111555 - RNA, 1410 nt, Artificial Sequence; identical to SEQ ID NO: 108250
  derived and/or modified sequence opt2 from neuraminidase__InfluenzaA__ADO12176

SEQ ID NO: 111556 - RNA, 1410 nt, Artificial Sequence; identical to SEQ ID NO: 108250
  derived and/or modified sequence opt2 from neuraminidase__InfluenzaA__ADO12186

SEQ ID NO: 111557 - RNA, 1410 nt, Artificial Sequence; identical to SEQ ID NO: 108250
  derived and/or modified sequence opt2 from neuraminidase__InfluenzaA__ADO12196

SEQ ID NO: 111558 - RNA, 1410 nt, Artificial Sequence; identical to SEQ ID NO: 108250
  derived and/or modified sequence opt2 from neuraminidase__InfluenzaA__ADO12206

SEQ ID NO: 111559 - RNA, 1410 nt, Artificial Sequence; identical to SEQ ID NO: 108250
  derived and/or modified sequence opt2 from neuraminidase__InfluenzaA__ADO12216

SEQ ID NO: 111560 - RNA, 1410 nt, Artificial Sequence; identical to SEQ ID NO: 108250
  derived and/or modified sequence opt2 from neuraminidase__InfluenzaA__ADO12226

SEQ ID NO: 111561 - RNA, 1410 nt, Artificial Sequence; identical to SEQ ID NO: 108250
  derived and/or modified sequence opt2 from neuraminidase__InfluenzaA__ADO12246

SEQ ID NO: 111562 - RNA, 1410 nt, Artificial Sequence; identical to SEQ ID NO: 108250
  derived and/or modified sequence opt2 from neuraminidase__InfluenzaA__ADO12266

SEQ ID NO: 111563 - RNA, 1410 nt, Artificial Sequence
  derived and/or modified sequence opt2 from neuraminidase__InfluenzaA__ADO12276
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaaguccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111564 - RNA, 1410 nt, Artificial Sequence; identical to SEQ ID NO: 108250
  derived and/or modified sequence opt2 from neuraminidase__InfluenzaA__ADO12286

SEQ ID NO: 111565 - RNA, 1410 nt, Artificial Sequence; identical to SEQ ID NO: 108250
  derived and/or modified sequence opt2 from neuraminidase__InfluenzaA__ADO12296

SEQ ID NO: 111566 - RNA, 1410 nt, Artificial Sequence; identical to SEQ ID NO: 108250
  derived and/or modified sequence opt2 from neuraminidase__InfluenzaA__ADO12306

SEQ ID NO: 111567 - RNA, 1410 nt, Artificial Sequence
  derived and/or modified sequence opt2 from neuraminidase__InfluenzaA__ADO12316
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcgacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111568 - RNA, 1410 nt, Artificial Sequence; identical to SEQ ID NO: 108250
  derived and/or modified sequence opt2 from neuraminidase__InfluenzaA__ADO12326

SEQ ID NO: 111569 - RNA, 1410 nt, Artificial Sequence; identical to SEQ ID NO: 108250
  derived and/or modified sequence opt2 from neuraminidase__InfluenzaA__ADO12336

SEQ ID NO: 111570 - RNA, 1410 nt, Artificial Sequence; identical to SEQ ID NO: 108250
  derived and/or modified sequence opt2 from neuraminidase__InfluenzaA__ADO12346

SEQ ID NO: 111571 - RNA, 1410 nt, Artificial Sequence; identical to SEQ ID NO: 108250
  derived and/or modified sequence opt2 from neuraminidase__InfluenzaA__ADO12356

SEQ ID NO: 111572 - RNA, 1410 nt, Artificial Sequence; identical to SEQ ID NO: 108250
  derived and/or modified sequence opt2 from neuraminidase__InfluenzaA__ADO12366

SEQ ID NO: 111573 - RNA, 1410 nt, Artificial Sequence; identical to SEQ ID NO: 108250
  derived and/or modified sequence opt2 from neuraminidase__InfluenzaA__ADO12376

SEQ ID NO: 111574 - RNA, 1410 nt, Artificial Sequence; identical to SEQ ID NO: 108250
  derived and/or modified sequence opt2 from neuraminidase__InfluenzaA__ADO12386

SEQ ID NO: 111575 - RNA, 1410 nt, Artificial Sequence; identical to SEQ ID NO: 108250
  derived and/or modified sequence opt2 from neuraminidase__InfluenzaA__ADO12396

SEQ ID NO: 111576 - RNA, 1410 nt, Artificial Sequence; identical to SEQ ID NO: 108250
  derived and/or modified sequence opt2 from neuraminidase__InfluenzaA__ADO12406

SEQ ID NO: 111577 - RNA, 1410 nt, Artificial Sequence; identical to SEQ ID NO: 109017
  derived and/or modified sequence opt2 from neuraminidase__InfluenzaA__ADO12416

SEQ ID NO: 111578 - RNA, 1410 nt, Artificial Sequence; identical to SEQ ID NO: 108250
  derived and/or modified sequence opt2 from neuraminidase__InfluenzaA__ADO12426

SEQ ID NO: 111579 - RNA, 1410 nt, Artificial Sequence; identical to SEQ ID NO: 108250
  derived and/or modified sequence opt2 from neuraminidase__InfluenzaA__ADO12436

SEQ ID NO: 111580 - RNA, 1410 nt, Artificial Sequence; identical to SEQ ID NO: 108250
  derived and/or modified sequence opt2 from neuraminidase__InfluenzaA__ADO12446

SEQ ID NO: 111581 - RNA, 1410 nt, Artificial Sequence; identical to SEQ ID NO: 108250
  derived and/or modified sequence opt2 from neuraminidase__InfluenzaA__ADO12456

SEQ ID NO: 111582 - RNA, 1410 nt, Artificial Sequence; identical to SEQ ID NO: 108250
  derived and/or modified sequence opt2 from neuraminidase__InfluenzaA__ADO12466

SEQ ID NO: 111583 - RNA, 1410 nt, Artificial Sequence; identical to SEQ ID NO: 108250
  derived and/or modified sequence opt2 from neuraminidase__InfluenzaA__ADO12476

SEQ ID NO: 111584 - RNA, 1410 nt, Artificial Sequence; identical to SEQ ID NO: 108250
  derived and/or modified sequence opt2 from neuraminidase__InfluenzaA__ADO12486

SEQ ID NO: 111585 - RNA, 1410 nt, Artificial Sequence; identical to SEQ ID NO: 108250
  derived and/or modified sequence opt2 from neuraminidase__InfluenzaA__ADO12496

SEQ ID NO: 111586 - RNA, 1410 nt, Artificial Sequence; identical to SEQ ID NO: 108250
  derived and/or modified sequence opt2 from neuraminidase__InfluenzaA__ADO12506

SEQ ID NO: 111587 - RNA, 1410 nt, Artificial Sequence; identical to SEQ ID NO: 108250
  derived and/or modified sequence opt2 from neuraminidase__InfluenzaA__ADO12516

SEQ ID NO: 111588 - RNA, 1410 nt, Artificial Sequence; identical to SEQ ID NO: 108250
  derived and/or modified sequence opt2 from neuraminidase__InfluenzaA__ADO12526

SEQ ID NO: 111589 - RNA, 1410 nt, Artificial Sequence; identical to SEQ ID NO: 108250
  derived and/or modified sequence opt2 from neuraminidase__InfluenzaA__ADO12536

SEQ ID NO: 111590 - RNA, 1410 nt, Artificial Sequence; identical to SEQ ID NO: 108250
  derived and/or modified sequence opt2 from neuraminidase__InfluenzaA__ADO12546

SEQ ID NO: 111591 - RNA, 1410 nt, Artificial Sequence; identical to SEQ ID NO: 108250
  derived and/or modified sequence opt2 from neuraminidase__InfluenzaA__ADO12556

SEQ ID NO: 111592 - RNA, 1410 nt, Artificial Sequence; identical to SEQ ID NO: 108250
  derived and/or modified sequence opt2 from neuraminidase__InfluenzaA__ADO12566

SEQ ID NO: 111593 - RNA, 1410 nt, Artificial Sequence; identical to SEQ ID NO: 108250
  derived and/or modified sequence opt2 from neuraminidase__InfluenzaA__ADO12576

SEQ ID NO: 111594 - RNA, 1410 nt, Artificial Sequence
  derived and/or modified sequence opt2 from neuraminidase__InfluenzaA__ADO12586
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111595 - RNA, 1410 nt, Artificial Sequence; identical to SEQ ID NO: 111594
  derived and/or modified sequence opt2 from neuraminidase__InfluenzaA__ADO12596

SEQ ID NO: 111596 - RNA, 1410 nt, Artificial Sequence; identical to SEQ ID NO: 108250
  derived and/or modified sequence opt2 from neuraminidase__InfluenzaA__ADO12606

SEQ ID NO: 111597 - RNA, 1410 nt, Artificial Sequence; identical to SEQ ID NO: 108250
  derived and/or modified sequence opt2 from neuraminidase__InfluenzaA__ADO12616

SEQ ID NO: 111598 - RNA, 1410 nt, Artificial Sequence; identical to SEQ ID NO: 108250
  derived and/or modified sequence opt2 from neuraminidase__InfluenzaA__ADO12626

SEQ ID NO: 111599 - RNA, 1410 nt, Artificial Sequence; identical to SEQ ID NO: 108250
  derived and/or modified sequence opt2 from neuraminidase__InfluenzaA__ADO14355

SEQ ID NO: 111600 - RNA, 1401 nt, Artificial Sequence
  derived and/or modified sequence opt2 from neuraminidase__InfluenzaA__ADO21028
augaaccccaaccagaagaucaucgccaucggcuccgucucccucaccaucgccaccaucugcuuccucaugcagaucgccauccucgccaccaccaugacccuccacuucaagcagaacgagugcuccaaccccuccaacaaccaggucguccccugcgagcccaccaucaucgagcgcaacaucguccaccucaacuccaccaccaucgagaaggagaucugccccaaggucgccgaguacaagaacugguccaagccccagugccagaucaccggcuccgcccccuucuccaagggcaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcgucccccaccgcacccuccucauguccgagcucggcguccccuuccaccucggcaccaagcaggucugcaucgccugguccuccuccuccugccacgacggcaaggccuggcuccacgucugcgucaccggcgacgacaagaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcaacgacgacuccuacuccuccuccaacugccgcgaccccaacaacgagcgcggcgcccccggcgucaagggcugggccuucgacaacggcaacgacaucuggaugggccgcaccaucaaggaggacucccgcuccggcuacgagaccuuccgcgucgucggcggcuggaccaccgccaacuccaagucccagaucaaccgccaggucaucgucgacuccgacaacugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 111601 - RNA, 1401 nt, Artificial Sequence
  derived and/or modified sequence opt2 from neuraminidase__InfluenzaA__ADO21039
augaaccccaaccagaagaucaucgccaucggcuccgucucccucaccaucgccaccaucugcuuccucaugcagaucgccauccucgccaccaccaugacccuccacuucaagcagaacgagugcuccaaccccuccaacaaccaggucguccccugcgagcccaccaucaucgagcgcaacaucguccaccucaacuccaccaccaucgagaaggagaucugccccaaggucgccgaguacaagaacugguccaagccccagugccagaucaccggcuccgcccccuucuccaagggcaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcgacccccaccgcacccuccucauguccgagcucggcguccccuuccaccucggcaccaagcaggucugcaucgccugguccuccuccuccugccacgacggcaaggccuggcuccacgucugcgucaccggcgacgacaagaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacaccaucgaguccuccuacgucugcuccggccucgucggcgacaccccccgcaacgacgacuccuacuccuccuccaacugccgcgaccccaacaacgagcgcggcgcccccggcgucaagggcugggccuucgacaacggcaacgacaucuggaugggccgcaccaucaaggaggacucccgcuccggcuacgagaccuuccgcgucgucggcggcuggaccaccgccaacuccaagucccagaucaaccgccaggucaucgucgacuccgacaacugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 111602 - RNA, 1401 nt, Artificial Sequence
  derived and/or modified sequence opt2 from neuraminidase__InfluenzaA__ADO21050
augaaccccaaccagaagaucaucgccaucggcuccgucucccucaccaucgccaccaucugcuuccucaugcagaucgccauccucgccaccaccaugacccuccacuucaagcagaacgagugcuccaaccccuccaacaaccaggucguccccugcgagcccaccaucaucgagcgcaacaucguccaccucaacuccaccaccaucgagaaggagaucugccccaaggucgccgaguacaagaacugguccaagccccagugccagaucaccggcuccgcccccuucuccaagggcaacuccauccgccucuccgccggcggcgacaucugggucacccgcgagcccuacgucuccugcucccucggcaagugcuaccaguucgcccucggccagggcaccacccucaagaacaagcacuccaacggcaccacccacgaccgcggcccccaccgcacccuccucauguccgagcucggcguccccuuccaccucggcaccaagcaggucugcaucgccugguccuccuccuccugccacgacggcaaggccuggcuccacgucugcgucaccggcgacgacaagaacgccaccgccuccaucaucuacgacggcaugcucgucgacuccaucggcuccugguccaagaacauccuccgcacccaggaguccgagugcgucugcaucaacggcaccugcaccgucgucaugaccgacggcuccgccuccggcaaggccgacacccgcauccucuucauccgcgagggcaagaucguccacaucuccccccucuccggcuccgcccagcacgucgaggagugcuccugcuacccccgcuaccccgagguccgcugcgucugccgcgacaacuggaagggcuccaaccgccccguccucuacaucaacauggccgacuacuccaucgaguccuccuacgucugcuccggccucgucggcgacaccccccgcaacgacgacuccuacuccuccuccaacugccgcgaccccaacaacgaguccggcgcccccggcgucaagggcugggccuucgacaacggcaacgacaucuggaugggccgcaccaucaaggaggacucccgcuccggcuacgagaccuuccgcgucgucggcggcuggaccaccgccaacuccaagucccagaucaaccgccaggucaucgucgacuccgacaacugguccggcuacuccggcaucuucuccgucgagggcaagaacugcaucaaccgcugcuucuacgucgagcucauccgcggccgcccccaggagacccgcgucugguggaccuccaacuccaucaucgucuucugcggcaccuccggcaccuacggcaccggcuccuggcccgacggcgccaacaucaacuucaugcccaucuga

SEQ ID NO: 111603 - RNA, 1410 nt, Artificial Sequence
  derived and/or modified sequence opt2 from neuraminidase__InfluenzaA__ADO25095
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111604 - RNA, 1410 nt, Artificial Sequence
  derived and/or modified sequence opt2 from neuraminidase__InfluenzaA__ADO25105
augaaccccaaccagaagaucaucaccaucggcuccgucugcaugaccaucggcauggccaaccucauccuccagaucggcaacaucaucuccaucuggaucucccacuccauccagcucggcaaccagaaccagaucggcaccugcaaccaguccgucaucaccuacgagaccaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgaccgccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111605 - RNA, 1410 nt, Artificial Sequence; identical to SEQ ID NO: 110031
  derived and/or modified sequence opt2 from neuraminidase__InfluenzaA__ADO25115

SEQ ID NO: 111606 - RNA, 1410 nt, Artificial Sequence; identical to SEQ ID NO: 110031
  derived and/or modified sequence opt2 from neuraminidase__InfluenzaA__ADO25125

SEQ ID NO: 111607 - RNA, 1410 nt, Artificial Sequence
  derived and/or modified sequence opt2 from neuraminidase__InfluenzaA__ADO25135
augaaccccaaccagaagaucaucaccaucggcuccgucugcaugaccaucggcauggccaaccucguccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111608 - RNA, 1410 nt, Artificial Sequence; identical to SEQ ID NO: 109601
  derived and/or modified sequence opt2 from neuraminidase__InfluenzaA__ADO25145

SEQ ID NO: 111609 - RNA, 1410 nt, Artificial Sequence; identical to SEQ ID NO: 108250
  derived and/or modified sequence opt2 from neuraminidase__InfluenzaA__ADO25155

SEQ ID NO: 111610 - RNA, 1410 nt, Artificial Sequence; identical to SEQ ID NO: 108250
  derived and/or modified sequence opt2 from neuraminidase__InfluenzaA__ADO25165

SEQ ID NO: 111611 - RNA, 1410 nt, Artificial Sequence; identical to SEQ ID NO: 108250
  derived and/or modified sequence opt2 from neuraminidase__InfluenzaA__ADO25175

SEQ ID NO: 111612 - RNA, 1410 nt, Artificial Sequence
  derived and/or modified sequence opt2 from neuraminidase__InfluenzaA__ADO25185
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccauguccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111613 - RNA, 1410 nt, Artificial Sequence; identical to SEQ ID NO: 110679
  derived and/or modified sequence opt2 from neuraminidase__InfluenzaA__ADO25195

SEQ ID NO: 111614 - RNA, 1410 nt, Artificial Sequence; identical to SEQ ID NO: 109387
  derived and/or modified sequence opt2 from neuraminidase__InfluenzaA__ADO25205

SEQ ID NO: 111615 - RNA, 1410 nt, Artificial Sequence; identical to SEQ ID NO: 109601
  derived and/or modified sequence opt2 from neuraminidase__InfluenzaA__ADO25215

SEQ ID NO: 111616 - RNA, 1410 nt, Artificial Sequence; identical to SEQ ID NO: 108250
  derived and/or modified sequence opt2 from neuraminidase__InfluenzaA__ADO25225

SEQ ID NO: 111617 - RNA, 1410 nt, Artificial Sequence; identical to SEQ ID NO: 109601
  derived and/or modified sequence opt2 from neuraminidase__InfluenzaA__ADO25235

SEQ ID NO: 111618 - RNA, 1410 nt, Artificial Sequence; identical to SEQ ID NO: 108250
  derived and/or modified sequence opt2 from neuraminidase__InfluenzaA__ADO25245

SEQ ID NO: 111619 - RNA, 1410 nt, Artificial Sequence; identical to SEQ ID NO: 108250
  derived and/or modified sequence opt2 from neuraminidase__InfluenzaA__ADO25255

SEQ ID NO: 111620 - RNA, 1410 nt, Artificial Sequence; identical to SEQ ID NO: 110031
  derived and/or modified sequence opt2 from neuraminidase__InfluenzaA__ADO25265

SEQ ID NO: 111621 - RNA, 1410 nt, Artificial Sequence; identical to SEQ ID NO: 109842
  derived and/or modified sequence opt2 from neuraminidase__InfluenzaA__ADO25275

SEQ ID NO: 111622 - RNA, 1410 nt, Artificial Sequence; identical to SEQ ID NO: 109601
  derived and/or modified sequence opt2 from neuraminidase__InfluenzaA__ADO25285

SEQ ID NO: 111623 - RNA, 1413 nt, Artificial Sequence
  derived and/or modified sequence opt2 from neuraminidase__InfluenzaA__ADO27623
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgccgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111624 - RNA, 1410 nt, Artificial Sequence; identical to SEQ ID NO: 108250
  derived and/or modified sequence opt2 from neuraminidase__InfluenzaA__ADO30410

SEQ ID NO: 111625 - RNA, 1410 nt, Artificial Sequence; identical to SEQ ID NO: 109601
  derived and/or modified sequence opt2 from neuraminidase__InfluenzaA__ADO30420

SEQ ID NO: 111626 - RNA, 1410 nt, Artificial Sequence; identical to SEQ ID NO: 108958
  derived and/or modified sequence opt2 from neuraminidase__InfluenzaA__ADP95343

SEQ ID NO: 111627 - RNA, 1410 nt, Artificial Sequence; identical to SEQ ID NO: 108240
  derived and/or modified sequence opt2 from neuraminidase__InfluenzaA__ADP95353

SEQ ID NO: 111628 - RNA, 1410 nt, Artificial Sequence; identical to SEQ ID NO: 108240
  derived and/or modified sequence opt2 from neuraminidase__InfluenzaA__ADP95363

SEQ ID NO: 111629 - RNA, 1410 nt, Artificial Sequence; identical to SEQ ID NO: 108240
  derived and/or modified sequence opt2 from neuraminidase__InfluenzaA__ADP95373

SEQ ID NO: 111630 - RNA, 1410 nt, Artificial Sequence; identical to SEQ ID NO: 108240
  derived and/or modified sequence opt2 from neuraminidase__InfluenzaA__ADP95383

SEQ ID NO: 111631 - RNA, 1410 nt, Artificial Sequence; identical to SEQ ID NO: 108240
  derived and/or modified sequence opt2 from neuraminidase__InfluenzaA__ADP95393

SEQ ID NO: 111632 - RNA, 1410 nt, Artificial Sequence
  derived and/or modified sequence opt2 from neuraminidase__InfluenzaA__ADQ43774
augaaccccaaccagaagaucaucaccaucggcuccggcugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaaggcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111633 - RNA, 1410 nt, Artificial Sequence
  derived and/or modified sequence opt2 from neuraminidase__InfluenzaA__ADQ92578
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucauccucugcgagcccaccaucaucgagcgcaacaucaccgagaucgucuaccucaccaacgccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111634 - RNA, 1410 nt, Artificial Sequence; identical to SEQ ID NO: 108111
  derived and/or modified sequence opt2 from neuraminidase__InfluenzaA__ADR32364

SEQ ID NO: 111635 - RNA, 1410 nt, Artificial Sequence
  derived and/or modified sequence opt2 from neuraminidase__InfluenzaA__ADT64478
augaaccccaaccagaagaucaucaccaucggcuccgucugcaugaccaucggcauggccaaccucauccuccagaucggcaacaucaucuccaucuggaucggccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111636 - RNA, 1410 nt, Artificial Sequence
  derived and/or modified sequence opt2 from neuraminidase__InfluenzaA__ADT78889
augaaccccaaccagaagaucaucaccaucggcuccgucucccucaccaucgccaccgucugcuuccucaugcagaucgccauccucgucaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccagaucaaccgccaggucaucgucgacuccaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucuccuucaugcccaucuga

SEQ ID NO: 111637 - RNA, 1410 nt, Artificial Sequence
  derived and/or modified sequence opt2 from neuraminidase__InfluenzaA__ADT78899
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucaugcgcgagcccuacgucuccugcaaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccuccuccaucgucgucuucugcggcaccuccggcaccuacggcaccggcuccuggcccgacggcgccaacaucaacuucaugcccaucuga

SEQ ID NO: 111638 - RNA, 1410 nt, Artificial Sequence
  derived and/or modified sequence opt2 from neuraminidase__InfluenzaA__ADT78963
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacgucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgaccgcuccuccaacuccaacugccgcgaccccaacaacgagcgcggcaaccccggcgucaagggcugggccuucgacaacggcaacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgccagcaggagacccgcgucugguggaccuccaacuccaucgucgucuucugcggcaccuccggcaccuacggcaccggcuccuggcccgacggcgccaacaucaacuucaugcccaucuga

SEQ ID NO: 111639 - RNA, 1410 nt, Artificial Sequence
  derived and/or modified sequence opt2 from neuraminidase__InfluenzaA__ADT79001
augaaccccaaccagaagaucaucaccaucggcuccaucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggcaaggccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagcgcggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 111640 - RNA, 1410 nt, Artificial Sequence; identical to SEQ ID NO: 105630
  derived and/or modified sequence opt2 from neuraminidase__InfluenzaA__ADT79021

SEQ ID NO: 111641 - RNA, 1410 nt, Artificial Sequence
  derived and/or modified sequence opt2 from neuraminidase__InfluenzaA__ADT79041
augaaccccaaccagaagaucaucaccaucggcuccgucucccucaccaucgccaccgucugcuuccucaugcagaucgccauccucgucaccaccgucacccuccacuuccgccaguacgagugcgacucccccgccaacaaccaggucaugcccugcgagcccaucaucaucgagcgcaacaucaccgagaucgucuaccucaacaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucgaggacuacuccaucgacuccuccuacgucugcuccggccucgucggcgacaccccccgcaacaacgaccgcuccuccaacuccaacugccgcaaccccaacaacgagcgcggcaaccacggcgucaagggcugggccuucgacgacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 111642 - RNA, 1410 nt, Artificial Sequence; identical to SEQ ID NO: 107272
  derived and/or modified sequence opt2 from neuraminidase__InfluenzaA__ADT79121

SEQ ID NO: 111643 - RNA, 1410 nt, Artificial Sequence
  derived and/or modified sequence opt2 from neuraminidase__InfluenzaA__ADT79131
augaaccccaaccagaagaucaucaccaucggcuccgucucccucaccaucgccaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgaggacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccguccucgacaucuccauggaggacuacuccaucgacuccuccuacgucugcuccggccucgucggcgacaccccccgcaacgacgacuccuccuccaacuccaacugccgcgaccccaacaacgagcgcggcaaccccggcgucaagggcugggccuucgacaacggcgacgacgucuggaugggccgcaccaucuccaaggaccuccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcucccaggagacccgcgucugguggaccuccaacuccaucgucgucuucugcggcaccuccggcaccuacggcaccggcuccuggcccgacggcgccaacaucaacuucaugcccaucuga

SEQ ID NO: 111644 - RNA, 1410 nt, Artificial Sequence; identical to SEQ ID NO: 108250
  derived and/or modified sequence opt2 from neuraminidase__InfluenzaA__ADT79234

SEQ ID NO: 111645 - RNA, 1410 nt, Artificial Sequence; identical to SEQ ID NO: 108240
  derived and/or modified sequence opt2 from neuraminidase__InfluenzaA__ADT79244

SEQ ID NO: 111646 - RNA, 1410 nt, Artificial Sequence
  derived and/or modified sequence opt2 from neuraminidase__InfluenzaA__ADU25480
augaaccccaaccagaagaucaucaucaucuccuccaucugccucaucaacggcaucaccucccucauccuccagaucggcaacaucaucuccaucuggaucucccacuccauccagaucggcaaccagaaccagaccgagaccugcucccagaacaucaucaccuacgagaacaacaccugggucaaccagaccuacgucaacaucuccaacaacaacuucgucgccgagcaggccgucgucuccaugaagcucgccggcuccuccccccucugccccgucuccggcugggccaucuacuccaaggacaacuccguccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaccuccuggcucaccaucggcaucuccggccccgacaacggcgccgucgccguccucaaguacaacgacaucaucaccgacaccaucaaguccuggcgcaacaacauccuccgcacccaggaguccgagugcgucugcgucaacggcuccugcuucaccgucaugaccgacggccccuccaacggccaggccuccuacaagaucuucaagaucgagaagggcaaggucgucaaguccgucgagcucaacgcccccaacuaccacuacgaggagugcuccugcuaccccgacuccggcgagaucaucugcgucugccgcgacaacuggcacggcuccaaccgccccugggucuccuucaaccagaaccucgaguaccagaucggcuacaucugcuccggcauccucggcgacaacccccgccccaacgaccgcaccggcuccugcggccccgucucccucaacggcgccaacggcgucaagggcuucuccuucaaguacggcaacggcgucuggaucggccgcaccaaguccuccuccucccgcuccggcuucgagaugaucugggaccccaacggcuggaccgagaccgacaacaacuuccucgucaagcaggacaucgucggcaugaccgacugguccggcuacuccggcuccuucguccagcaccccgagcucaccggcaugaacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 111647 - RNA, 1410 nt, Artificial Sequence; identical to SEQ ID NO: 108250
  derived and/or modified sequence opt2 from neuraminidase__InfluenzaA__ADU59780

SEQ ID NO: 111648 - RNA, 1410 nt, Artificial Sequence
  derived and/or modified sequence opt2 from neuraminidase__InfluenzaA__ADU59789
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacgucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111649 - RNA, 1410 nt, Artificial Sequence; identical to SEQ ID NO: 108250
  derived and/or modified sequence opt2 from neuraminidase__InfluenzaA__ADU59829

SEQ ID NO: 111650 - RNA, 1410 nt, Artificial Sequence
  derived and/or modified sequence opt2 from neuraminidase__InfluenzaA__ADU59838
augaaccccaaccagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuucgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 111651 - RNA, 1410 nt, Artificial Sequence; identical to SEQ ID NO: 109601
  derived and/or modified sequence opt2 from neuraminidase__InfluenzaA__ADU59847

SEQ ID NO: 111652 - RNA, 1410 nt, Artificial Sequence; identical to SEQ ID NO: 108250
  derived and/or modified sequence opt2 from neuraminidase__InfluenzaA__ADU59907

SEQ ID NO: 111653 - RNA, 1410 nt, Artificial Sequence; identical to SEQ ID NO: 108250
  derived and/or modified sequence opt2 from neuraminidase__InfluenzaA__ADU59917

SEQ ID NO: 111654 - RNA, 1410 nt, Artificial Sequence; identical to SEQ ID NO: 108250
  derived and/or modified sequence opt2 from neuraminidase__InfluenzaA__ADU59920

SEQ ID NO: 111655 - RNA, 1410 nt, Artificial Sequence; identical to SEQ ID NO: 108250
  derived and/or modified sequence opt2 from neuraminidase__InfluenzaA__ADU59941

SEQ ID NO: 111656 - RNA, 1410 nt, Artificial Sequence
  derived and/or modified sequence opt2 from neuraminidase__InfluenzaA__ADU76311
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccaagcuccccuucaccaucgacaaguga

SEQ ID NO: 111657 - RNA, 1410 nt, Artificial Sequence
  derived and/or modified sequence opt2 from neuraminidase__InfluenzaA__ADU76313
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccaagcuccccuucaccaucgacaaguga

SEQ ID NO: 111658 - RNA, 1410 nt, Artificial Sequence; identical to SEQ ID NO: 111657
  derived and/or modified sequence opt2 from neuraminidase__InfluenzaA__ADU76314

SEQ ID NO: 111659 - RNA, 1410 nt, Artificial Sequence; identical to SEQ ID NO: 111657
  derived and/or modified sequence opt2 from neuraminidase__InfluenzaA__ADU76315

SEQ ID NO: 111660 - RNA, 1410 nt, Artificial Sequence; identical to SEQ ID NO: 111657
  derived and/or modified sequence opt2 from neuraminidase__InfluenzaA__ADU76316

SEQ ID NO: 111661 - RNA, 1410 nt, Artificial Sequence
  derived and/or modified sequence opt2 from neuraminidase__InfluenzaA__ADU76317
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111662 - RNA, 1410 nt, Artificial Sequence
  derived and/or modified sequence opt2 from neuraminidase__InfluenzaA__ADU76318
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccacaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111663 - RNA, 1410 nt, Artificial Sequence; identical to SEQ ID NO: 109493
  derived and/or modified sequence opt2 from neuraminidase__InfluenzaA__ADU76319

SEQ ID NO: 111664 - RNA, 1410 nt, Artificial Sequence; identical to SEQ ID NO: 108250
  derived and/or modified sequence opt2 from neuraminidase__InfluenzaA__ADU76320

SEQ ID NO: 111665 - RNA, 1410 nt, Artificial Sequence; identical to SEQ ID NO: 108250
  derived and/or modified sequence opt2 from neuraminidase__InfluenzaA__ADU76321

SEQ ID NO: 111666 - RNA, 1410 nt, Artificial Sequence
  derived and/or modified sequence opt2 from neuraminidase__InfluenzaA__ADU76322
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaaggucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 111667 - RNA, 1410 nt, Artificial Sequence; identical to SEQ ID NO: 111656
  derived and/or modified sequence opt2 from neuraminidase__InfluenzaA__ADU76323

SEQ ID NO: 111668 - RNA, 1410 nt, Artificial Sequence; identical to SEQ ID NO: 111657
  derived and/or modified sequence opt2 from neuraminidase__InfluenzaA__ADU76324

SEQ ID NO: 111669 - RNA, 1410 nt, Artificial Sequence; identical to SEQ ID NO: 111656
  derived and/or modified sequence opt2 from neuraminidase__InfluenzaA__ADU76325

SEQ ID NO: 111670 - RNA, 1410 nt, Artificial Sequence; identical to SEQ ID NO: 111657
  derived and/or modified sequence opt2 from neuraminidase__InfluenzaA__ADU76326

SEQ ID NO: 111671 - RNA, 1410 nt, Artificial Sequence; identical to SEQ ID NO: 111657
  derived and/or modified sequence opt2 from neuraminidase__InfluenzaA__ADU76327

SEQ ID NO: 111672 - RNA, 1410 nt, Artificial Sequence; identical to SEQ ID NO: 111656
  derived and/or modified sequence opt2 from neuraminidase__InfluenzaA__ADU76328

SEQ ID NO: 111673 - RNA, 1410 nt, Artificial Sequence; identical to SEQ ID NO: 111657
  derived and/or modified sequence opt2 from neuraminidase__InfluenzaA__ADU76329

SEQ ID NO: 111674 - RNA, 1410 nt, Artificial Sequence; identical to SEQ ID NO: 111657
  derived and/or modified sequence opt2 from neuraminidase__InfluenzaA__ADU76330

SEQ ID NO: 111675 - RNA, 1410 nt, Artificial Sequence; identical to SEQ ID NO: 111657
  derived and/or modified sequence opt2 from neuraminidase__InfluenzaA__ADU76331

SEQ ID NO: 111676 - RNA, 1410 nt, Artificial Sequence; identical to SEQ ID NO: 111657
  derived and/or modified sequence opt2 from neuraminidase__InfluenzaA__ADU76332

SEQ ID NO: 111677 - RNA, 1410 nt, Artificial Sequence; identical to SEQ ID NO: 108250
  derived and/or modified sequence opt2 from neuraminidase__InfluenzaA__ADU76333

SEQ ID NO: 111678 - RNA, 1410 nt, Artificial Sequence; identical to SEQ ID NO: 108250
  derived and/or modified sequence opt2 from neuraminidase__InfluenzaA__ADU76334

SEQ ID NO: 111679 - RNA, 1410 nt, Artificial Sequence; identical to SEQ ID NO: 108250
  derived and/or modified sequence opt2 from neuraminidase__InfluenzaA__ADU76335

SEQ ID NO: 111680 - RNA, 1410 nt, Artificial Sequence; identical to SEQ ID NO: 111657
  derived and/or modified sequence opt2 from neuraminidase__InfluenzaA__ADU76336

SEQ ID NO: 111681 - RNA, 1410 nt, Artificial Sequence; identical to SEQ ID NO: 109017
  derived and/or modified sequence opt2 from neuraminidase__InfluenzaA__ADU76337

SEQ ID NO: 111682 - RNA, 1410 nt, Artificial Sequence; identical to SEQ ID NO: 110152
  derived and/or modified sequence opt2 from neuraminidase__InfluenzaA__ADU76338

SEQ ID NO: 111683 - RNA, 1410 nt, Artificial Sequence; identical to SEQ ID NO: 111656
  derived and/or modified sequence opt2 from neuraminidase__InfluenzaA__ADU76339

SEQ ID NO: 111684 - RNA, 1410 nt, Artificial Sequence; identical to SEQ ID NO: 108250
  derived and/or modified sequence opt2 from neuraminidase__InfluenzaA__ADU76341

SEQ ID NO: 111685 - RNA, 1410 nt, Artificial Sequence; identical to SEQ ID NO: 108250
  derived and/or modified sequence opt2 from neuraminidase__InfluenzaA__ADU76342

SEQ ID NO: 111686 - RNA, 1410 nt, Artificial Sequence; identical to SEQ ID NO: 108250
  derived and/or modified sequence opt2 from neuraminidase__InfluenzaA__ADU76343

SEQ ID NO: 111687 - RNA, 1410 nt, Artificial Sequence; identical to SEQ ID NO: 111657
  derived and/or modified sequence opt2 from neuraminidase__InfluenzaA__ADU76344

SEQ ID NO: 111688 - RNA, 1410 nt, Artificial Sequence; identical to SEQ ID NO: 111657
  derived and/or modified sequence opt2 from neuraminidase__InfluenzaA__ADU76345

SEQ ID NO: 111689 - RNA, 1410 nt, Artificial Sequence
  derived and/or modified sequence opt2 from neuraminidase__InfluenzaA__ADU76346
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111690 - RNA, 1410 nt, Artificial Sequence; identical to SEQ ID NO: 109017
  derived and/or modified sequence opt2 from neuraminidase__InfluenzaA__ADU76347

SEQ ID NO: 111691 - RNA, 1410 nt, Artificial Sequence
  derived and/or modified sequence opt2 from neuraminidase__InfluenzaA__ADV17285
augaaccccaaccaggagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuuccgcuacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111692 - RNA, 1410 nt, Artificial Sequence; identical to SEQ ID NO: 108250
  derived and/or modified sequence opt2 from neuraminidase__InfluenzaA__ADV17295

SEQ ID NO: 111693 - RNA, 1410 nt, Artificial Sequence
  derived and/or modified sequence opt2 from neuraminidase__InfluenzaA__ADV17305
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccucccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggcuccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111694 - RNA, 1410 nt, Artificial Sequence; identical to SEQ ID NO: 108250
  derived and/or modified sequence opt2 from neuraminidase__InfluenzaA__ADV17315

SEQ ID NO: 111695 - RNA, 1410 nt, Artificial Sequence; identical to SEQ ID NO: 109681
  derived and/or modified sequence opt2 from neuraminidase__InfluenzaA__ADV17325

SEQ ID NO: 111696 - RNA, 1410 nt, Artificial Sequence
  derived and/or modified sequence opt2 from neuraminidase__InfluenzaA__ADV17335
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcgucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagugccccuucaccaucgacaaguga

SEQ ID NO: 111697 - RNA, 1410 nt, Artificial Sequence; identical to SEQ ID NO: 108250
  derived and/or modified sequence opt2 from neuraminidase__InfluenzaA__ADV19022

SEQ ID NO: 111698 - RNA, 1410 nt, Artificial Sequence
  derived and/or modified sequence opt2 from neuraminidase__InfluenzaA__ADV41679
augaaccccaaccagaagaucaucaccaucggcuccgucugcaugaccaucggcauggccaaccucauccuccagaucggcaacaucaucuccaucuggaucucccacuccauccagcuccgcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111699 - RNA, 1410 nt, Artificial Sequence
  derived and/or modified sequence opt2 from neuraminidase__InfluenzaA__ADV76582
augaaccccaaccagaagaucaucaccaucggcuccgucucccucaccaucuccaccgucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 111700 - RNA, 1410 nt, Artificial Sequence; identical to SEQ ID NO: 108111
  derived and/or modified sequence opt2 from neuraminidase__InfluenzaA__ADV76590

SEQ ID NO: 111701 - RNA, 1410 nt, Artificial Sequence; identical to SEQ ID NO: 108111
  derived and/or modified sequence opt2 from neuraminidase__InfluenzaA__ADV76601

SEQ ID NO: 111702 - RNA, 1410 nt, Artificial Sequence; identical to SEQ ID NO: 109104
  derived and/or modified sequence opt2 from neuraminidase__InfluenzaA__ADV76612

SEQ ID NO: 111703 - RNA, 1410 nt, Artificial Sequence; identical to SEQ ID NO: 108111
  derived and/or modified sequence opt2 from neuraminidase__InfluenzaA__ADV76623

SEQ ID NO: 111704 - RNA, 1410 nt, Artificial Sequence; identical to SEQ ID NO: 108111
  derived and/or modified sequence opt2 from neuraminidase__InfluenzaA__ADV76634

SEQ ID NO: 111705 - RNA, 1410 nt, Artificial Sequence; identical to SEQ ID NO: 110978
  derived and/or modified sequence opt2 from neuraminidase__InfluenzaA__ADV76645

SEQ ID NO: 111706 - RNA, 1410 nt, Artificial Sequence
  derived and/or modified sequence opt2 from neuraminidase__InfluenzaA__ADV76667
augaaccccaaccagaagaucaucaccaucggcuccgucucccucaccaucgccaccgucugcuuccucaugcagaucgccauccucgucaccaccgucacccuccacuucaagcaguacgagugcgacucccccgccuccaaccaggucaugcccugcgagcccaucaucaucgagcgcaacaucaccgagaucgucuaccucaacaacaccaccaucgagaaggagaucugccccaaggucgucgaguaccgcaacugguccaagccccagugccagaucaccggcuucgcccccuucuccaaggacaacuccauccgccucuccgccggcggcgacaucugggucacccgcgagcccuacgucuccugcgaccacggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacauggaggacuacuccaucgacuccuccuacgucugcuccggccucgucggcgacaccccccgcaacgacgaccgcuccuccaacuccaagucccgcaaccccaacaacgagcgcggcaaccagggcgucaagggcugggccuucgacaacggcgacgacgucuggaugggccgcaccaucucccgcgaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccaacaucaacuucaugcccaucuga

SEQ ID NO: 111707 - RNA, 1410 nt, Artificial Sequence; identical to SEQ ID NO: 110980
  derived and/or modified sequence opt2 from neuraminidase__InfluenzaA__ADV76676

SEQ ID NO: 111708 - RNA, 1410 nt, Artificial Sequence; identical to SEQ ID NO: 110121
  derived and/or modified sequence opt2 from neuraminidase__InfluenzaA__ADV76697

SEQ ID NO: 111709 - RNA, 1410 nt, Artificial Sequence
  derived and/or modified sequence opt2 from neuraminidase__InfluenzaA__ADV76708
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaucaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111710 - RNA, 1410 nt, Artificial Sequence
  derived and/or modified sequence opt2 from neuraminidase__InfluenzaA__ADV76719
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaugaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111711 - RNA, 1410 nt, Artificial Sequence
  derived and/or modified sequence opt2 from neuraminidase__InfluenzaA__ADV76730
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagacccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaaggacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111712 - RNA, 1410 nt, Artificial Sequence
  derived and/or modified sequence opt2 from neuraminidase__InfluenzaA__ADV78132
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggcucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucggcaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucugggccuccggcuccuccaucuccuucugcggcgucaacuccgacaccgucggcugguccuggcccgacggcgccgagcuccccuucaucaucgacaaguga

SEQ ID NO: 111713 - RNA, 1413 nt, Artificial Sequence
  derived and/or modified sequence opt2 from neuraminidase__InfluenzaA__ADW09104
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccaacaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111714 - RNA, 1413 nt, Artificial Sequence; identical to SEQ ID NO: 108973
  derived and/or modified sequence opt2 from neuraminidase__InfluenzaA__ADW09114

SEQ ID NO: 111715 - RNA, 1413 nt, Artificial Sequence
  derived and/or modified sequence opt2 from neuraminidase__InfluenzaA__ADW09123
augaaccccaaccagaagaucaucaccaucggcuccaucuccaucgccaucggcaucaccucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111716 - RNA, 1413 nt, Artificial Sequence
  derived and/or modified sequence opt2 from neuraminidase__InfluenzaA__ADW09156
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111717 - RNA, 1413 nt, Artificial Sequence
  derived and/or modified sequence opt2 from neuraminidase__InfluenzaA__ADW09167
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111718 - RNA, 1413 nt, Artificial Sequence; identical to SEQ ID NO: 108973
  derived and/or modified sequence opt2 from neuraminidase__InfluenzaA__ADW09178

SEQ ID NO: 111719 - RNA, 1413 nt, Artificial Sequence; identical to SEQ ID NO: 108973
  derived and/or modified sequence opt2 from neuraminidase__InfluenzaA__ADW09189

SEQ ID NO: 111720 - RNA, 1413 nt, Artificial Sequence; identical to SEQ ID NO: 111717
  derived and/or modified sequence opt2 from neuraminidase__InfluenzaA__ADW09211

SEQ ID NO: 111721 - RNA, 1413 nt, Artificial Sequence
  derived and/or modified sequence opt2 from neuraminidase__InfluenzaA__ADW09222
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaacuccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111722 - RNA, 1413 nt, Artificial Sequence
  derived and/or modified sequence opt2 from neuraminidase__InfluenzaA__ADW09233
augaaccccaaccagaagaucaucaccaucggcuccaucuccaucgccaucggcaccaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111723 - RNA, 1413 nt, Artificial Sequence; identical to SEQ ID NO: 111716
  derived and/or modified sequence opt2 from neuraminidase__InfluenzaA__ADW09244

SEQ ID NO: 111724 - RNA, 1413 nt, Artificial Sequence; identical to SEQ ID NO: 111716
  derived and/or modified sequence opt2 from neuraminidase__InfluenzaA__ADW09255

SEQ ID NO: 111725 - RNA, 1413 nt, Artificial Sequence; identical to SEQ ID NO: 111716
  derived and/or modified sequence opt2 from neuraminidase__InfluenzaA__ADW09266

SEQ ID NO: 111726 - RNA, 1413 nt, Artificial Sequence; identical to SEQ ID NO: 111716
  derived and/or modified sequence opt2 from neuraminidase__InfluenzaA__ADW09277

SEQ ID NO: 111727 - RNA, 1413 nt, Artificial Sequence; identical to SEQ ID NO: 108973
  derived and/or modified sequence opt2 from neuraminidase__InfluenzaA__ADW09288

SEQ ID NO: 111728 - RNA, 1413 nt, Artificial Sequence; identical to SEQ ID NO: 111717
  derived and/or modified sequence opt2 from neuraminidase__InfluenzaA__ADW09299

SEQ ID NO: 111729 - RNA, 1413 nt, Artificial Sequence; identical to SEQ ID NO: 108973
  derived and/or modified sequence opt2 from neuraminidase__InfluenzaA__ADW09310

SEQ ID NO: 111730 - RNA, 1413 nt, Artificial Sequence; identical to SEQ ID NO: 108973
  derived and/or modified sequence opt2 from neuraminidase__InfluenzaA__ADW09330

SEQ ID NO: 111731 - RNA, 1413 nt, Artificial Sequence; identical to SEQ ID NO: 111716
  derived and/or modified sequence opt2 from neuraminidase__InfluenzaA__ADW10475

SEQ ID NO: 111732 - RNA, 1413 nt, Artificial Sequence; identical to SEQ ID NO: 111717
  derived and/or modified sequence opt2 from neuraminidase__InfluenzaA__ADW10486

SEQ ID NO: 111733 - RNA, 1413 nt, Artificial Sequence; identical to SEQ ID NO: 108973
  derived and/or modified sequence opt2 from neuraminidase__InfluenzaA__ADW10497

SEQ ID NO: 111734 - RNA, 1413 nt, Artificial Sequence
  derived and/or modified sequence opt2 from neuraminidase__InfluenzaA__ADW10508
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccucgucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111735 - RNA, 1413 nt, Artificial Sequence; identical to SEQ ID NO: 108973
  derived and/or modified sequence opt2 from neuraminidase__InfluenzaA__ADW10519

SEQ ID NO: 111736 - RNA, 1413 nt, Artificial Sequence; identical to SEQ ID NO: 108973
  derived and/or modified sequence opt2 from neuraminidase__InfluenzaA__ADW10530

SEQ ID NO: 111737 - RNA, 1413 nt, Artificial Sequence
  derived and/or modified sequence opt2 from neuraminidase__InfluenzaA__ADW10541
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcauggacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111738 - RNA, 1413 nt, Artificial Sequence
  derived and/or modified sequence opt2 from neuraminidase__InfluenzaA__ADW10552
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccgacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111739 - RNA, 1413 nt, Artificial Sequence; identical to SEQ ID NO: 111449
  derived and/or modified sequence opt2 from neuraminidase__InfluenzaA__ADW10563

SEQ ID NO: 111740 - RNA, 1413 nt, Artificial Sequence; identical to SEQ ID NO: 108973
  derived and/or modified sequence opt2 from neuraminidase__InfluenzaA__ADW10574

SEQ ID NO: 111741 - RNA, 1413 nt, Artificial Sequence
  derived and/or modified sequence opt2 from neuraminidase__InfluenzaA__ADW10585
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaaguccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgaguaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111742 - RNA, 1413 nt, Artificial Sequence; identical to SEQ ID NO: 111717
  derived and/or modified sequence opt2 from neuraminidase__InfluenzaA__ADW10596

SEQ ID NO: 111743 - RNA, 1413 nt, Artificial Sequence; identical to SEQ ID NO: 111716
  derived and/or modified sequence opt2 from neuraminidase__InfluenzaA__ADW10607

SEQ ID NO: 111744 - RNA, 1413 nt, Artificial Sequence; identical to SEQ ID NO: 111716
  derived and/or modified sequence opt2 from neuraminidase__InfluenzaA__ADW10618

SEQ ID NO: 111745 - RNA, 1413 nt, Artificial Sequence; identical to SEQ ID NO: 111716
  derived and/or modified sequence opt2 from neuraminidase__InfluenzaA__ADW10629

SEQ ID NO: 111746 - RNA, 1413 nt, Artificial Sequence; identical to SEQ ID NO: 111716
  derived and/or modified sequence opt2 from neuraminidase__InfluenzaA__ADW10724

SEQ ID NO: 111747 - RNA, 1413 nt, Artificial Sequence; identical to SEQ ID NO: 111717
  derived and/or modified sequence opt2 from neuraminidase__InfluenzaA__ADW10735

SEQ ID NO: 111748 - RNA, 1413 nt, Artificial Sequence; identical to SEQ ID NO: 111717
  derived and/or modified sequence opt2 from neuraminidase__InfluenzaA__ADW10746

SEQ ID NO: 111749 - RNA, 1413 nt, Artificial Sequence
  derived and/or modified sequence opt2 from neuraminidase__InfluenzaA__ADW10757
augaaccccaaccagaagaucaucaccaucggcuccaucuccaucgccaucggcaucaucucccucaugcuccagaucggcaacaucaucuccaucugggccucccacuccauccagacccgcucccagaacaacaccggcaucugcaaccagcgcaucaucaccuacgagaacuccaccugggucaaccacaccuacgucaacaucaacaacaccaacgucgucgccggcggcgacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucacccucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111750 - RNA, 1413 nt, Artificial Sequence; identical to SEQ ID NO: 111716
  derived and/or modified sequence opt2 from neuraminidase__InfluenzaA__ADW10768

SEQ ID NO: 111751 - RNA, 1413 nt, Artificial Sequence; identical to SEQ ID NO: 108973
  derived and/or modified sequence opt2 from neuraminidase__InfluenzaA__ADW10779

SEQ ID NO: 111752 - RNA, 1413 nt, Artificial Sequence
  derived and/or modified sequence opt2 from neuraminidase__InfluenzaA__ADW10790
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcaucauccccugcuucugggucgagcucguccgcggccucccccgcgagaacgccaccaucuggaccuccggcuccuccaucuccuucugcggcgucaacuccgacaccgccaacugguccuggcccgacggcgccgagcuccccuucaccaucgacaaguga

SEQ ID NO: 111753 - RNA, 1413 nt, Artificial Sequence; identical to SEQ ID NO: 110442
  derived and/or modified sequence opt2 from neuraminidase__InfluenzaA__ADW10801

SEQ ID NO: 111754 - RNA, 1413 nt, Artificial Sequence; identical to SEQ ID NO: 111716
  derived and/or modified sequence opt2 from neuraminidase__InfluenzaA__ADW10812

SEQ ID NO: 111755 - RNA, 1413 nt, Artificial Sequence; identical to SEQ ID NO: 111468
  derived and/or modified sequence opt2 from neuraminidase__InfluenzaA__ADW10823

SEQ ID NO: 111756 - RNA, 1413 nt, Artificial Sequence
  derived and/or modified sequence opt2 from neuraminidase__InfluenzaA__ADW10834
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaucaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111757 - RNA, 1413 nt, Artificial Sequence; identical to SEQ ID NO: 111717
  derived and/or modified sequence opt2 from neuraminidase__InfluenzaA__ADW10845

SEQ ID NO: 111758 - RNA, 1413 nt, Artificial Sequence
  derived and/or modified sequence opt2 from neuraminidase__InfluenzaA__ADW10856
augaaccccaaccagcgcaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111759 - RNA, 1413 nt, Artificial Sequence; identical to SEQ ID NO: 111716
  derived and/or modified sequence opt2 from neuraminidase__InfluenzaA__ADW10867

SEQ ID NO: 111760 - RNA, 1413 nt, Artificial Sequence; identical to SEQ ID NO: 111716
  derived and/or modified sequence opt2 from neuraminidase__InfluenzaA__ADW10878

SEQ ID NO: 111761 - RNA, 1413 nt, Artificial Sequence; identical to SEQ ID NO: 111716
  derived and/or modified sequence opt2 from neuraminidase__InfluenzaA__ADW10889

SEQ ID NO: 111762 - RNA, 1413 nt, Artificial Sequence; identical to SEQ ID NO: 108973
  derived and/or modified sequence opt2 from neuraminidase__InfluenzaA__ADW10900

SEQ ID NO: 111763 - RNA, 1410 nt, Artificial Sequence; identical to SEQ ID NO: 109996
  derived and/or modified sequence opt2 from neuraminidase__InfluenzaA__ADW11155

SEQ ID NO: 111764 - RNA, 1410 nt, Artificial Sequence; identical to SEQ ID NO: 108250
  derived and/or modified sequence opt2 from neuraminidase__InfluenzaA__ADW23530

SEQ ID NO: 111765 - RNA, 1410 nt, Artificial Sequence
  derived and/or modified sequence opt2 from neuraminidase__InfluenzaA__ADW54483
augaaccccaaccagaagaucaucaccaucggcuccgucugcaugaccaucggcauggccaaccucaugcuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111766 - RNA, 1410 nt, Artificial Sequence
  derived and/or modified sequence opt2 from neuraminidase__InfluenzaA__ADW54494
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111767 - RNA, 1410 nt, Artificial Sequence
  derived and/or modified sequence opt2 from neuraminidase__InfluenzaA__ADW54514
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaagaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111768 - RNA, 1410 nt, Artificial Sequence
  derived and/or modified sequence opt2 from neuraminidase__InfluenzaA__ADW54522
augaaccccaaccagaagaucaucaccaucggcuccgucugcaugaucaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaaccgccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111769 - RNA, 1410 nt, Artificial Sequence
  derived and/or modified sequence opt2 from neuraminidase__InfluenzaA__ADW65826
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111770 - RNA, 1410 nt, Artificial Sequence; identical to SEQ ID NO: 108111
  derived and/or modified sequence opt2 from neuraminidase__InfluenzaA__ADW80519

SEQ ID NO: 111771 - RNA, 1410 nt, Artificial Sequence; identical to SEQ ID NO: 108111
  derived and/or modified sequence opt2 from neuraminidase__InfluenzaA__ADW82127

SEQ ID NO: 111772 - RNA, 1410 nt, Artificial Sequence; identical to SEQ ID NO: 108111
  derived and/or modified sequence opt2 from neuraminidase__InfluenzaA__ADW82138

SEQ ID NO: 111773 - RNA, 1410 nt, Artificial Sequence; identical to SEQ ID NO: 108111
  derived and/or modified sequence opt2 from neuraminidase__InfluenzaA__ADW82149

SEQ ID NO: 111774 - RNA, 1410 nt, Artificial Sequence; identical to SEQ ID NO: 108111
  derived and/or modified sequence opt2 from neuraminidase__InfluenzaA__ADW82158

SEQ ID NO: 111775 - RNA, 1410 nt, Artificial Sequence; identical to SEQ ID NO: 108111
  derived and/or modified sequence opt2 from neuraminidase__InfluenzaA__ADW82169

SEQ ID NO: 111776 - RNA, 1410 nt, Artificial Sequence; identical to SEQ ID NO: 108111
  derived and/or modified sequence opt2 from neuraminidase__InfluenzaA__ADW82180

SEQ ID NO: 111777 - RNA, 1410 nt, Artificial Sequence; identical to SEQ ID NO: 108250
  derived and/or modified sequence opt2 from neuraminidase__InfluenzaA__ADW82191

SEQ ID NO: 111778 - RNA, 1410 nt, Artificial Sequence; identical to SEQ ID NO: 108250
  derived and/or modified sequence opt2 from neuraminidase__InfluenzaA__ADW82201

SEQ ID NO: 111779 - RNA, 1410 nt, Artificial Sequence; identical to SEQ ID NO: 108250
  derived and/or modified sequence opt2 from neuraminidase__InfluenzaA__ADW82211

SEQ ID NO: 111780 - RNA, 1410 nt, Artificial Sequence; identical to SEQ ID NO: 108250
  derived and/or modified sequence opt2 from neuraminidase__InfluenzaA__ADW82221

SEQ ID NO: 111781 - RNA, 1410 nt, Artificial Sequence; identical to SEQ ID NO: 108250
  derived and/or modified sequence opt2 from neuraminidase__InfluenzaA__ADW82231

SEQ ID NO: 111782 - RNA, 1410 nt, Artificial Sequence; identical to SEQ ID NO: 108250
  derived and/or modified sequence opt2 from neuraminidase__InfluenzaA__ADW82241

SEQ ID NO: 111783 - RNA, 1410 nt, Artificial Sequence; identical to SEQ ID NO: 108250
  derived and/or modified sequence opt2 from neuraminidase__InfluenzaA__ADW82251

SEQ ID NO: 111784 - RNA, 1410 nt, Artificial Sequence; identical to SEQ ID NO: 108250
  derived and/or modified sequence opt2 from neuraminidase__InfluenzaA__ADW82261

SEQ ID NO: 111785 - RNA, 1410 nt, Artificial Sequence; identical to SEQ ID NO: 108250
  derived and/or modified sequence opt2 from neuraminidase__InfluenzaA__ADW82271

SEQ ID NO: 111786 - RNA, 1410 nt, Artificial Sequence; identical to SEQ ID NO: 111769
  derived and/or modified sequence opt2 from neuraminidase__InfluenzaA__ADW95306

SEQ ID NO: 111787 - RNA, 1410 nt, Artificial Sequence; identical to SEQ ID NO: 111769
  derived and/or modified sequence opt2 from neuraminidase__InfluenzaA__ADW95313

SEQ ID NO: 111788 - RNA, 1410 nt, Artificial Sequence; identical to SEQ ID NO: 111769
  derived and/or modified sequence opt2 from neuraminidase__InfluenzaA__ADW95320

SEQ ID NO: 111789 - RNA, 1410 nt, Artificial Sequence; identical to SEQ ID NO: 111769
  derived and/or modified sequence opt2 from neuraminidase__InfluenzaA__ADW95327

SEQ ID NO: 111790 - RNA, 1410 nt, Artificial Sequence
  derived and/or modified sequence opt2 from neuraminidase__InfluenzaA__ADW95333
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggcuccgccaaguccaucuccucccgcaaggccuucgagaugaucugggaccccaacggcuggaccggcaccgacaacaacuucuccaucaagcaguacaucgucggcaucaacgagugguccggcuacuccggcuccuucgucgagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111791 - RNA, 1410 nt, Artificial Sequence
  derived and/or modified sequence opt2 from neuraminidase__InfluenzaA__ADX20813
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgagcucgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccagaccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111792 - RNA, 1410 nt, Artificial Sequence
  derived and/or modified sequence opt2 from neuraminidase__InfluenzaA__ADX20814
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111793 - RNA, 1410 nt, Artificial Sequence; identical to SEQ ID NO: 108111
  derived and/or modified sequence opt2 from neuraminidase__InfluenzaA__ADX21091

SEQ ID NO: 111794 - RNA, 1410 nt, Artificial Sequence; identical to SEQ ID NO: 108250
  derived and/or modified sequence opt2 from neuraminidase__InfluenzaA__ADX21101

SEQ ID NO: 111795 - RNA, 1410 nt, Artificial Sequence; identical to SEQ ID NO: 109117
  derived and/or modified sequence opt2 from neuraminidase__InfluenzaA__ADX36112

SEQ ID NO: 111796 - RNA, 1410 nt, Artificial Sequence
  derived and/or modified sequence opt2 from neuraminidase__InfluenzaA__ADX87386
augaaccccaaccagcgcaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 111797 - RNA, 1410 nt, Artificial Sequence
  derived and/or modified sequence opt2 from neuraminidase__InfluenzaA__ADX96270
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgccuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111798 - RNA, 1410 nt, Artificial Sequence; identical to SEQ ID NO: 111797
  derived and/or modified sequence opt2 from neuraminidase__InfluenzaA__ADX96280

SEQ ID NO: 111799 - RNA, 1410 nt, Artificial Sequence; identical to SEQ ID NO: 108833
  derived and/or modified sequence opt2 from neuraminidase__InfluenzaA__ADX96290

SEQ ID NO: 111800 - RNA, 1410 nt, Artificial Sequence; identical to SEQ ID NO: 108250
  derived and/or modified sequence opt2 from neuraminidase__InfluenzaA__ADX96300

SEQ ID NO: 111801 - RNA, 1410 nt, Artificial Sequence; identical to SEQ ID NO: 108250
  derived and/or modified sequence opt2 from neuraminidase__InfluenzaA__ADX96310

SEQ ID NO: 111802 - RNA, 1410 nt, Artificial Sequence
  derived and/or modified sequence opt2 from neuraminidase__InfluenzaA__ADX96330
augaaccccaaccagaagaucaucaccaucggcuccgucugcaugaccaucggcauggccaaccucauccuccagaucggcaacggcaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccaacgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111803 - RNA, 1410 nt, Artificial Sequence; identical to SEQ ID NO: 108250
  derived and/or modified sequence opt2 from neuraminidase__InfluenzaA__ADX96339

SEQ ID NO: 111804 - RNA, 1410 nt, Artificial Sequence
  derived and/or modified sequence opt2 from neuraminidase__InfluenzaA__ADX96349
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccaacgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111805 - RNA, 1410 nt, Artificial Sequence; identical to SEQ ID NO: 108250
  derived and/or modified sequence opt2 from neuraminidase__InfluenzaA__ADX96359

SEQ ID NO: 111806 - RNA, 1410 nt, Artificial Sequence; identical to SEQ ID NO: 108250
  derived and/or modified sequence opt2 from neuraminidase__InfluenzaA__ADX96369

SEQ ID NO: 111807 - RNA, 1410 nt, Artificial Sequence
  derived and/or modified sequence opt2 from neuraminidase__InfluenzaA__ADX96380
augaaccccaaccagaagaucaucaccaucggcuccgucugcaugaccaucggcauggccaaccucauccuccagaucggcaacaucaucuccaucuggcccguccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucgaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111808 - RNA, 1410 nt, Artificial Sequence
  derived and/or modified sequence opt2 from neuraminidase__InfluenzaA__ADX96390
augaaccccaaccagaagaucaucaccaucggcuccgucugcaugaccaucggcauggccaaccucauccuccagaucggcaacaucaucuccaucuggcucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111809 - RNA, 1410 nt, Artificial Sequence; identical to SEQ ID NO: 108250
  derived and/or modified sequence opt2 from neuraminidase__InfluenzaA__ADX96400

SEQ ID NO: 111810 - RNA, 1410 nt, Artificial Sequence; identical to SEQ ID NO: 108250
  derived and/or modified sequence opt2 from neuraminidase__InfluenzaA__ADX96410

SEQ ID NO: 111811 - RNA, 1410 nt, Artificial Sequence; identical to SEQ ID NO: 108250
  derived and/or modified sequence opt2 from neuraminidase__InfluenzaA__ADX96419

SEQ ID NO: 111812 - RNA, 1410 nt, Artificial Sequence
  derived and/or modified sequence opt2 from neuraminidase__InfluenzaA__ADX96429
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucguccgcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111813 - RNA, 1410 nt, Artificial Sequence; identical to SEQ ID NO: 108250
  derived and/or modified sequence opt2 from neuraminidase__InfluenzaA__ADX96449

SEQ ID NO: 111814 - RNA, 1410 nt, Artificial Sequence; identical to SEQ ID NO: 108250
  derived and/or modified sequence opt2 from neuraminidase__InfluenzaA__ADX96469

SEQ ID NO: 111815 - RNA, 1410 nt, Artificial Sequence; identical to SEQ ID NO: 108250
  derived and/or modified sequence opt2 from neuraminidase__InfluenzaA__ADX96489

SEQ ID NO: 111816 - RNA, 1410 nt, Artificial Sequence; identical to SEQ ID NO: 108250
  derived and/or modified sequence opt2 from neuraminidase__InfluenzaA__ADX96499

SEQ ID NO: 111817 - RNA, 1410 nt, Artificial Sequence
  derived and/or modified sequence opt2 from neuraminidase__InfluenzaA__ADX96509
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaacggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111818 - RNA, 1410 nt, Artificial Sequence; identical to SEQ ID NO: 108250
  derived and/or modified sequence opt2 from neuraminidase__InfluenzaA__ADX96519

SEQ ID NO: 111819 - RNA, 1410 nt, Artificial Sequence; identical to SEQ ID NO: 108250
  derived and/or modified sequence opt2 from neuraminidase__InfluenzaA__ADX96529

SEQ ID NO: 111820 - RNA, 1410 nt, Artificial Sequence; identical to SEQ ID NO: 108250
  derived and/or modified sequence opt2 from neuraminidase__InfluenzaA__ADX96539

SEQ ID NO: 111821 - RNA, 1410 nt, Artificial Sequence; identical to SEQ ID NO: 108250
  derived and/or modified sequence opt2 from neuraminidase__InfluenzaA__ADX96549

SEQ ID NO: 111822 - RNA, 1410 nt, Artificial Sequence; identical to SEQ ID NO: 108250
  derived and/or modified sequence opt2 from neuraminidase__InfluenzaA__ADX96559

SEQ ID NO: 111823 - RNA, 1410 nt, Artificial Sequence; identical to SEQ ID NO: 108250
  derived and/or modified sequence opt2 from neuraminidase__InfluenzaA__ADX96569

SEQ ID NO: 111824 - RNA, 1410 nt, Artificial Sequence; identical to SEQ ID NO: 108240
  derived and/or modified sequence opt2 from neuraminidase__InfluenzaA__ADX96579

SEQ ID NO: 111825 - RNA, 1410 nt, Artificial Sequence; identical to SEQ ID NO: 108250
  derived and/or modified sequence opt2 from neuraminidase__InfluenzaA__ADX96589

SEQ ID NO: 111826 - RNA, 1410 nt, Artificial Sequence; identical to SEQ ID NO: 108250
  derived and/or modified sequence opt2 from neuraminidase__InfluenzaA__ADX96599

SEQ ID NO: 111827 - RNA, 1410 nt, Artificial Sequence
  derived and/or modified sequence opt2 from neuraminidase__InfluenzaA__ADX96609
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucggcggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcgacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111828 - RNA, 1410 nt, Artificial Sequence; identical to SEQ ID NO: 108240
  derived and/or modified sequence opt2 from neuraminidase__InfluenzaA__ADX96619

SEQ ID NO: 111829 - RNA, 1410 nt, Artificial Sequence; identical to SEQ ID NO: 108250
  derived and/or modified sequence opt2 from neuraminidase__InfluenzaA__ADX96629

SEQ ID NO: 111830 - RNA, 1410 nt, Artificial Sequence; identical to SEQ ID NO: 108250
  derived and/or modified sequence opt2 from neuraminidase__InfluenzaA__ADX96639

SEQ ID NO: 111831 - RNA, 1410 nt, Artificial Sequence; identical to SEQ ID NO: 108250
  derived and/or modified sequence opt2 from neuraminidase__InfluenzaA__ADX96649

SEQ ID NO: 111832 - RNA, 1410 nt, Artificial Sequence; identical to SEQ ID NO: 108240
  derived and/or modified sequence opt2 from neuraminidase__InfluenzaA__ADX96659

SEQ ID NO: 111833 - RNA, 1410 nt, Artificial Sequence; identical to SEQ ID NO: 108250
  derived and/or modified sequence opt2 from neuraminidase__InfluenzaA__ADX96669

SEQ ID NO: 111834 - RNA, 1410 nt, Artificial Sequence; identical to SEQ ID NO: 108250
  derived and/or modified sequence opt2 from neuraminidase__InfluenzaA__ADX96679

SEQ ID NO: 111835 - RNA, 1410 nt, Artificial Sequence; identical to SEQ ID NO: 108250
  derived and/or modified sequence opt2 from neuraminidase__InfluenzaA__ADX96689

SEQ ID NO: 111836 - RNA, 1410 nt, Artificial Sequence; identical to SEQ ID NO: 108250
  derived and/or modified sequence opt2 from neuraminidase__InfluenzaA__ADX96699

SEQ ID NO: 111837 - RNA, 1410 nt, Artificial Sequence
  derived and/or modified sequence opt2 from neuraminidase__InfluenzaA__ADX96709
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacgagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111838 - RNA, 1410 nt, Artificial Sequence
  derived and/or modified sequence opt2 from neuraminidase__InfluenzaA__ADX96719
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaguucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucggcugguccuggcccgacggcgccgagcuccccuucaccaucgacaaguga

SEQ ID NO: 111839 - RNA, 1410 nt, Artificial Sequence; identical to SEQ ID NO: 108250
  derived and/or modified sequence opt2 from neuraminidase__InfluenzaA__ADX96729

SEQ ID NO: 111840 - RNA, 1410 nt, Artificial Sequence
  derived and/or modified sequence opt2 from neuraminidase__InfluenzaA__ADX96739
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaaguccgacaccgucggcugguccuggcccgacggcgccgagcuccccuucaccaucgacaaguga

SEQ ID NO: 111841 - RNA, 1410 nt, Artificial Sequence; identical to SEQ ID NO: 108250
  derived and/or modified sequence opt2 from neuraminidase__InfluenzaA__ADX96749

SEQ ID NO: 111842 - RNA, 1410 nt, Artificial Sequence; identical to SEQ ID NO: 108250
  derived and/or modified sequence opt2 from neuraminidase__InfluenzaA__ADX96759

SEQ ID NO: 111843 - RNA, 1410 nt, Artificial Sequence; identical to SEQ ID NO: 109224
  derived and/or modified sequence opt2 from neuraminidase__InfluenzaA__ADX96769

SEQ ID NO: 111844 - RNA, 1410 nt, Artificial Sequence; identical to SEQ ID NO: 108250
  derived and/or modified sequence opt2 from neuraminidase__InfluenzaA__ADX96779

SEQ ID NO: 111845 - RNA, 1410 nt, Artificial Sequence
  derived and/or modified sequence opt2 from neuraminidase__InfluenzaA__ADX96789
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucucccucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111846 - RNA, 1410 nt, Artificial Sequence; identical to SEQ ID NO: 108250
  derived and/or modified sequence opt2 from neuraminidase__InfluenzaA__ADX96799

SEQ ID NO: 111847 - RNA, 1410 nt, Artificial Sequence; identical to SEQ ID NO: 108405
  derived and/or modified sequence opt2 from neuraminidase__InfluenzaA__ADX96809

SEQ ID NO: 111848 - RNA, 1410 nt, Artificial Sequence; identical to SEQ ID NO: 108250
  derived and/or modified sequence opt2 from neuraminidase__InfluenzaA__ADX96819

SEQ ID NO: 111849 - RNA, 1410 nt, Artificial Sequence; identical to SEQ ID NO: 109473
  derived and/or modified sequence opt2 from neuraminidase__InfluenzaA__ADX96829

SEQ ID NO: 111850 - RNA, 1410 nt, Artificial Sequence
  derived and/or modified sequence opt2 from neuraminidase__InfluenzaA__ADX96839
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacaacguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111851 - RNA, 1410 nt, Artificial Sequence; identical to SEQ ID NO: 108250
  derived and/or modified sequence opt2 from neuraminidase__InfluenzaA__ADX96849

SEQ ID NO: 111852 - RNA, 1410 nt, Artificial Sequence; identical to SEQ ID NO: 108250
  derived and/or modified sequence opt2 from neuraminidase__InfluenzaA__ADX96859

SEQ ID NO: 111853 - RNA, 1410 nt, Artificial Sequence; identical to SEQ ID NO: 109473
  derived and/or modified sequence opt2 from neuraminidase__InfluenzaA__ADX96869

SEQ ID NO: 111854 - RNA, 1410 nt, Artificial Sequence; identical to SEQ ID NO: 108250
  derived and/or modified sequence opt2 from neuraminidase__InfluenzaA__ADX96879

SEQ ID NO: 111855 - RNA, 1410 nt, Artificial Sequence; identical to SEQ ID NO: 108250
  derived and/or modified sequence opt2 from neuraminidase__InfluenzaA__ADX96899

SEQ ID NO: 111856 - RNA, 1410 nt, Artificial Sequence
  derived and/or modified sequence opt2 from neuraminidase__InfluenzaA__ADX96909
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacgacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaacucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111857 - RNA, 1410 nt, Artificial Sequence; identical to SEQ ID NO: 108250
  derived and/or modified sequence opt2 from neuraminidase__InfluenzaA__ADX96919

SEQ ID NO: 111858 - RNA, 1410 nt, Artificial Sequence; identical to SEQ ID NO: 108250
  derived and/or modified sequence opt2 from neuraminidase__InfluenzaA__ADX96929

SEQ ID NO: 111859 - RNA, 1410 nt, Artificial Sequence; identical to SEQ ID NO: 108250
  derived and/or modified sequence opt2 from neuraminidase__InfluenzaA__ADX96939

SEQ ID NO: 111860 - RNA, 1410 nt, Artificial Sequence; identical to SEQ ID NO: 108833
  derived and/or modified sequence opt2 from neuraminidase__InfluenzaA__ADX96949

SEQ ID NO: 111861 - RNA, 1410 nt, Artificial Sequence; identical to SEQ ID NO: 108250
  derived and/or modified sequence opt2 from neuraminidase__InfluenzaA__ADX96959

SEQ ID NO: 111862 - RNA, 1410 nt, Artificial Sequence
  derived and/or modified sequence opt2 from neuraminidase__InfluenzaA__ADX96969
augaaccccaaccagaugaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111863 - RNA, 1410 nt, Artificial Sequence; identical to SEQ ID NO: 109473
  derived and/or modified sequence opt2 from neuraminidase__InfluenzaA__ADX96979

SEQ ID NO: 111864 - RNA, 1410 nt, Artificial Sequence; identical to SEQ ID NO: 109473
  derived and/or modified sequence opt2 from neuraminidase__InfluenzaA__ADX96989

SEQ ID NO: 111865 - RNA, 1407 nt, Artificial Sequence
  derived and/or modified sequence opt2 from neuraminidase__InfluenzaA__ADX96999
augaaccccaaccagaagaucaucaccaucggcuccgucugcaugaccaucggcauggccaaccucauccuccagaucggcaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111866 - RNA, 1410 nt, Artificial Sequence; identical to SEQ ID NO: 108250
  derived and/or modified sequence opt2 from neuraminidase__InfluenzaA__ADX97009

SEQ ID NO: 111867 - RNA, 1410 nt, Artificial Sequence; identical to SEQ ID NO: 108405
  derived and/or modified sequence opt2 from neuraminidase__InfluenzaA__ADX97020

SEQ ID NO: 111868 - RNA, 1410 nt, Artificial Sequence
  derived and/or modified sequence opt2 from neuraminidase__InfluenzaA__ADX97030
augaaccccaaccagaagaucaucaccaucggcuccgucugcaugaucaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111869 - RNA, 1410 nt, Artificial Sequence; identical to SEQ ID NO: 109798
  derived and/or modified sequence opt2 from neuraminidase__InfluenzaA__ADX98643

SEQ ID NO: 111870 - RNA, 1410 nt, Artificial Sequence; identical to SEQ ID NO: 108250
  derived and/or modified sequence opt2 from neuraminidase__InfluenzaA__ADX98653

SEQ ID NO: 111871 - RNA, 1410 nt, Artificial Sequence
  derived and/or modified sequence opt2 from neuraminidase__InfluenzaA__ADX98668
augaaccccaaccagaagaucaucaccaucggcuccaucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111872 - RNA, 1410 nt, Artificial Sequence; identical to SEQ ID NO: 108250
  derived and/or modified sequence opt2 from neuraminidase__InfluenzaA__ADX98678

SEQ ID NO: 111873 - RNA, 1410 nt, Artificial Sequence; identical to SEQ ID NO: 108250
  derived and/or modified sequence opt2 from neuraminidase__InfluenzaA__ADX98698

SEQ ID NO: 111874 - RNA, 1410 nt, Artificial Sequence
  derived and/or modified sequence opt2 from neuraminidase__InfluenzaA__ADX98708
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaucuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111875 - RNA, 1410 nt, Artificial Sequence; identical to SEQ ID NO: 108250
  derived and/or modified sequence opt2 from neuraminidase__InfluenzaA__ADX98722

SEQ ID NO: 111876 - RNA, 1410 nt, Artificial Sequence; identical to SEQ ID NO: 108250
  derived and/or modified sequence opt2 from neuraminidase__InfluenzaA__ADX98732

SEQ ID NO: 111877 - RNA, 1410 nt, Artificial Sequence; identical to SEQ ID NO: 108250
  derived and/or modified sequence opt2 from neuraminidase__InfluenzaA__ADX98742

SEQ ID NO: 111878 - RNA, 1410 nt, Artificial Sequence; identical to SEQ ID NO: 109601
  derived and/or modified sequence opt2 from neuraminidase__InfluenzaA__ADX98751

SEQ ID NO: 111879 - RNA, 1410 nt, Artificial Sequence; identical to SEQ ID NO: 108250
  derived and/or modified sequence opt2 from neuraminidase__InfluenzaA__ADX98761

SEQ ID NO: 111880 - RNA, 1410 nt, Artificial Sequence
  derived and/or modified sequence opt2 from neuraminidase__InfluenzaA__ADX98770
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccuggggcuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111881 - RNA, 1410 nt, Artificial Sequence; identical to SEQ ID NO: 108250
  derived and/or modified sequence opt2 from neuraminidase__InfluenzaA__ADX98780

SEQ ID NO: 111882 - RNA, 1410 nt, Artificial Sequence
  derived and/or modified sequence opt2 from neuraminidase__InfluenzaA__ADX98788
augaaccccaaccagaagaucaucaccaucggcuccgucugcaugaccaucggcauggccaaccucguccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111883 - RNA, 1410 nt, Artificial Sequence
  derived and/or modified sequence opt2 from neuraminidase__InfluenzaA__ADX98809
augaaccccaaccagaagaucaucaccaucggcuccgucugcaugaccaucggcauggccaaccucauccuccagaucggcaacaucauccucaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111884 - RNA, 1410 nt, Artificial Sequence; identical to SEQ ID NO: 108250
  derived and/or modified sequence opt2 from neuraminidase__InfluenzaA__ADX98821

SEQ ID NO: 111885 - RNA, 1410 nt, Artificial Sequence; identical to SEQ ID NO: 108250
  derived and/or modified sequence opt2 from neuraminidase__InfluenzaA__ADX98846

SEQ ID NO: 111886 - RNA, 1410 nt, Artificial Sequence
  derived and/or modified sequence opt2 from neuraminidase__InfluenzaA__ADX98856
augaaccccaaccagaagaucaugaccaucggcuccgucugcaugaccaucggcauggccaaccucauccuccagaucggcaacaucaucuccaucuggaucucccacuccauccagcucggcauccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111887 - RNA, 1410 nt, Artificial Sequence; identical to SEQ ID NO: 108250
  derived and/or modified sequence opt2 from neuraminidase__InfluenzaA__ADX98863

SEQ ID NO: 111888 - RNA, 1410 nt, Artificial Sequence; identical to SEQ ID NO: 108250
  derived and/or modified sequence opt2 from neuraminidase__InfluenzaA__ADX98873

SEQ ID NO: 111889 - RNA, 1410 nt, Artificial Sequence
  derived and/or modified sequence opt2 from neuraminidase__InfluenzaA__ADX98883
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacgucgccgccggccaguccgucgucuccgucaagcucgccggcaacuccucccucugccccgucuccggcugggccaucuacuccaaggacaacuccauccgcaucggcuccaagggcgacgccuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcuccggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111890 - RNA, 1410 nt, Artificial Sequence; identical to SEQ ID NO: 108250
  derived and/or modified sequence opt2 from neuraminidase__InfluenzaA__ADX98893

SEQ ID NO: 111891 - RNA, 1410 nt, Artificial Sequence; identical to SEQ ID NO: 108250
  derived and/or modified sequence opt2 from neuraminidase__InfluenzaA__ADX98903

SEQ ID NO: 111892 - RNA, 1410 nt, Artificial Sequence; identical to SEQ ID NO: 109803
  derived and/or modified sequence opt2 from neuraminidase__InfluenzaA__ADX98913

SEQ ID NO: 111893 - RNA, 1410 nt, Artificial Sequence; identical to SEQ ID NO: 109681
  derived and/or modified sequence opt2 from neuraminidase__InfluenzaA__ADX98923

SEQ ID NO: 111894 - RNA, 1410 nt, Artificial Sequence; identical to SEQ ID NO: 109687
  derived and/or modified sequence opt2 from neuraminidase__InfluenzaA__ADX98933

SEQ ID NO: 111895 - RNA, 1410 nt, Artificial Sequence; identical to SEQ ID NO: 108250
  derived and/or modified sequence opt2 from neuraminidase__InfluenzaA__ADX98943

SEQ ID NO: 111896 - RNA, 1410 nt, Artificial Sequence; identical to SEQ ID NO: 110207
  derived and/or modified sequence opt2 from neuraminidase__InfluenzaA__ADX98953

SEQ ID NO: 111897 - RNA, 1410 nt, Artificial Sequence; identical to SEQ ID NO: 108250
  derived and/or modified sequence opt2 from neuraminidase__InfluenzaA__ADX98963

SEQ ID NO: 111898 - RNA, 1410 nt, Artificial Sequence
  derived and/or modified sequence opt2 from neuraminidase__InfluenzaA__ADX98973
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucaugaucugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111899 - RNA, 1410 nt, Artificial Sequence; identical to SEQ ID NO: 108250
  derived and/or modified sequence opt2 from neuraminidase__InfluenzaA__ADX98983

SEQ ID NO: 111900 - RNA, 1410 nt, Artificial Sequence; identical to SEQ ID NO: 108250
  derived and/or modified sequence opt2 from neuraminidase__InfluenzaA__ADX98993

SEQ ID NO: 111901 - RNA, 1410 nt, Artificial Sequence; identical to SEQ ID NO: 108250
  derived and/or modified sequence opt2 from neuraminidase__InfluenzaA__ADX99003

SEQ ID NO: 111902 - RNA, 1365 nt, Artificial Sequence
  derived and/or modified sequence opt2 from neuraminidase__InfluenzaA__ADX99584
augaaccccaaccagaagaucaccaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 111903 - RNA, 1365 nt, Artificial Sequence; identical to SEQ ID NO: 111902
  derived and/or modified sequence opt2 from neuraminidase__InfluenzaA__ADX99595

SEQ ID NO: 111904 - RNA, 1365 nt, Artificial Sequence; identical to SEQ ID NO: 111902
  derived and/or modified sequence opt2 from neuraminidase__InfluenzaA__ADX99606

SEQ ID NO: 111905 - RNA, 1365 nt, Artificial Sequence; identical to SEQ ID NO: 111902
  derived and/or modified sequence opt2 from neuraminidase__InfluenzaA__ADX99617

SEQ ID NO: 111906 - RNA, 1365 nt, Artificial Sequence; identical to SEQ ID NO: 111902
  derived and/or modified sequence opt2 from neuraminidase__InfluenzaA__ADX99628

SEQ ID NO: 111907 - RNA, 1365 nt, Artificial Sequence; identical to SEQ ID NO: 111902
  derived and/or modified sequence opt2 from neuraminidase__InfluenzaA__ADX99639

SEQ ID NO: 111908 - RNA, 1365 nt, Artificial Sequence; identical to SEQ ID NO: 107231
  derived and/or modified sequence opt2 from neuraminidase__InfluenzaA__ADX99650

SEQ ID NO: 111909 - RNA, 1365 nt, Artificial Sequence; identical to SEQ ID NO: 107231
  derived and/or modified sequence opt2 from neuraminidase__InfluenzaA__ADX99672

SEQ ID NO: 111910 - RNA, 1365 nt, Artificial Sequence; identical to SEQ ID NO: 107231
  derived and/or modified sequence opt2 from neuraminidase__InfluenzaA__ADX99683

SEQ ID NO: 111911 - RNA, 1365 nt, Artificial Sequence; identical to SEQ ID NO: 107231
  derived and/or modified sequence opt2 from neuraminidase__InfluenzaA__ADX99694

SEQ ID NO: 111912 - RNA, 1365 nt, Artificial Sequence; identical to SEQ ID NO: 107231
  derived and/or modified sequence opt2 from neuraminidase__InfluenzaA__ADX99705

SEQ ID NO: 111913 - RNA, 1365 nt, Artificial Sequence; identical to SEQ ID NO: 107231
  derived and/or modified sequence opt2 from neuraminidase__InfluenzaA__ADX99846

SEQ ID NO: 111914 - RNA, 1365 nt, Artificial Sequence; identical to SEQ ID NO: 107231
  derived and/or modified sequence opt2 from neuraminidase__InfluenzaA__ADX99857

SEQ ID NO: 111915 - RNA, 1365 nt, Artificial Sequence; identical to SEQ ID NO: 107231
  derived and/or modified sequence opt2 from neuraminidase__InfluenzaA__ADX99868

SEQ ID NO: 111916 - RNA, 1365 nt, Artificial Sequence; identical to SEQ ID NO: 107231
  derived and/or modified sequence opt2 from neuraminidase__InfluenzaA__ADX99879

SEQ ID NO: 111917 - RNA, 1365 nt, Artificial Sequence; identical to SEQ ID NO: 107231
  derived and/or modified sequence opt2 from neuraminidase__InfluenzaA__ADX99890

SEQ ID NO: 111918 - RNA, 1365 nt, Artificial Sequence; identical to SEQ ID NO: 107231
  derived and/or modified sequence opt2 from neuraminidase__InfluenzaA__ADX99901

SEQ ID NO: 111919 - RNA, 1365 nt, Artificial Sequence
  derived and/or modified sequence opt2 from neuraminidase__InfluenzaA__ADX99912
augaaccccaaccagaagaucaucaccaucggcuccaucugccucgucgucggccucaucucccucauccuccagaucggcaacaucaucuccaucuggaucucccacuccauccagaccggcucccagaaccacaccggcaucugcaaccagaacaucaucaccuacaagaacuccaccugggucaaggacaccaccuccgucauccucaccggcaacuccucccucugccccauccgcggcugggccaucuacuccaaggacaacuccauccgcaucggcuccaagggcgacgucuucaucauccgcgagcccuucaucuccugcucccaccucgagugccgcaccuucuuccucacccagggcgcccuccucaacgacaagcacuccuccggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcgccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccgaggacggcaccggcuccugcggccccgucuacgucgacggcgccaacggcgucaagggcuucuccuaccgcuacggcaacggcgucuggaucggccgcaccaagucccacuccucccgccacggcuucgagaugaucugggaccccaacggcuggaccgagaccgacuccaaguucuccguccgccaggacgucgucgccaugaccgacugguccggcuacuccggcuccuucguccagcaccccgagcucaccggccucgacugcaugcgccccugcuucugggucgagcucauccgcggccgccccaaggagaagaccaucuggaccuccgccuccuccaucuccuucugcggcgucaacuccgacaccgucgacugguccuggcccgacggcgccgagcuccccuucuccaucgacaaguga

SEQ ID NO: 111920 - RNA, 1365 nt, Artificial Sequence; identical to SEQ ID NO: 107231
  derived and/or modified sequence opt2 from neuraminidase__InfluenzaA__ADX99923

SEQ ID NO: 111921 - RNA, 1365 nt, Artificial Sequence; identical to SEQ ID NO: 107231
  derived and/or modified sequence opt2 from neuraminidase__InfluenzaA__ADX99934

SEQ ID NO: 111922 - RNA, 1365 nt, Artificial Sequence; identical to SEQ ID NO: 107231
  derived and/or modified sequence opt2 from neuraminidase__InfluenzaA__ADX99956

SEQ ID NO: 111923 - RNA, 1365 nt, Artificial Sequence; identical to SEQ ID NO: 107231
  derived and/or modified sequence opt2 from neuraminidase__InfluenzaA__ADX99967

SEQ ID NO: 111924 - RNA, 1365 nt, Artificial Sequence; identical to SEQ ID NO: 107231
  derived and/or modified sequence opt2 from neuraminidase__InfluenzaA__ADX99978

SEQ ID NO: 111925 - RNA, 1365 nt, Artificial Sequence; identical to SEQ ID NO: 107231
  derived and/or modified sequence opt2 from neuraminidase__InfluenzaA__ADX99989

SEQ ID NO: 111926 - RNA, 1365 nt, Artificial Sequence; identical to SEQ ID NO: 107231
  derived and/or modified sequence opt2 from neuraminidase__InfluenzaA__ADY00001

SEQ ID NO: 111927 - RNA, 1365 nt, Artificial Sequence; identical to SEQ ID NO: 107231
  derived and/or modified sequence opt2 from neuraminidase__InfluenzaA__ADY00012

SEQ ID NO: 111928 - RNA, 1365 nt, Artificial Sequence; identical to SEQ ID NO: 107231
  derived and/or modified sequence opt2 from neuraminidase__InfluenzaA__ADY00023

SEQ ID NO: 111929 - RNA, 1413 nt, Artificial Sequence
  derived and/or modified sequence opt2 from neuraminidase__InfluenzaA__ADY04729
augaaccccaaccagaagaucaucaccaucggcuccaucuccaucgccaucggcaucaucucccucaugcuccagaucggcaacaucaucuccaucugggccucccacuccauccagaccggcucccagaaccacaccggcgucugcaaccagcgcaucaucaccuacgagaacuccaccugggucaaccacaccuacgucaacaucaacaacaccaacgucaucgccggcaaggacaagaccuccgucaccauggccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 111930 - RNA, 1410 nt, Artificial Sequence; identical to SEQ ID NO: 111030
  derived and/or modified sequence opt2 from neuraminidase__InfluenzaA__ADY11828

SEQ ID NO: 111931 - RNA, 1410 nt, Artificial Sequence; identical to SEQ ID NO: 108111
  derived and/or modified sequence opt2 from neuraminidase__InfluenzaA__ADY11839

SEQ ID NO: 111932 - RNA, 1410 nt, Artificial Sequence; identical to SEQ ID NO: 108111
  derived and/or modified sequence opt2 from neuraminidase__InfluenzaA__ADY17657

SEQ ID NO: 111933 - RNA, 1410 nt, Artificial Sequence; identical to SEQ ID NO: 108111
  derived and/or modified sequence opt2 from neuraminidase__InfluenzaA__ADY17668

SEQ ID NO: 111934 - RNA, 1410 nt, Artificial Sequence; identical to SEQ ID NO: 108111
  derived and/or modified sequence opt2 from neuraminidase__InfluenzaA__ADY17679

SEQ ID NO: 111935 - RNA, 1410 nt, Artificial Sequence; identical to SEQ ID NO: 108111
  derived and/or modified sequence opt2 from neuraminidase__InfluenzaA__ADY17690

SEQ ID NO: 111936 - RNA, 1410 nt, Artificial Sequence; identical to SEQ ID NO: 108111
  derived and/or modified sequence opt2 from neuraminidase__InfluenzaA__ADY17701

SEQ ID NO: 111937 - RNA, 1410 nt, Artificial Sequence; identical to SEQ ID NO: 108250
  derived and/or modified sequence opt2 from neuraminidase__InfluenzaA__ADY38722

SEQ ID NO: 111938 - RNA, 1410 nt, Artificial Sequence; identical to SEQ ID NO: 109999
  derived and/or modified sequence opt2 from neuraminidase__InfluenzaA__ADY38723

SEQ ID NO: 111939 - RNA, 1410 nt, Artificial Sequence; identical to SEQ ID NO: 108250
  derived and/or modified sequence opt2 from neuraminidase__InfluenzaA__ADY38734

SEQ ID NO: 111940 - RNA, 1410 nt, Artificial Sequence; identical to SEQ ID NO: 109842
  derived and/or modified sequence opt2 from neuraminidase__InfluenzaA__ADY38753

SEQ ID NO: 111941 - RNA, 1410 nt, Artificial Sequence; identical to SEQ ID NO: 108250
  derived and/or modified sequence opt2 from neuraminidase__InfluenzaA__ADY38763

SEQ ID NO: 111942 - RNA, 1410 nt, Artificial Sequence; identical to SEQ ID NO: 108250
  derived and/or modified sequence opt2 from neuraminidase__InfluenzaA__ADZ04600

SEQ ID NO: 111943 - RNA, 1410 nt, Artificial Sequence; identical to SEQ ID NO: 108250
  derived and/or modified sequence opt2 from neuraminidase__InfluenzaA__ADZ04610

SEQ ID NO: 111944 - RNA, 1410 nt, Artificial Sequence; identical to SEQ ID NO: 108250
  derived and/or modified sequence opt2 from neuraminidase__InfluenzaA__ADZ04693

SEQ ID NO: 111945 - RNA, 1410 nt, Artificial Sequence; identical to SEQ ID NO: 108250
  derived and/or modified sequence opt2 from neuraminidase__InfluenzaA__ADZ04701

SEQ ID NO: 111946 - RNA, 1410 nt, Artificial Sequence; identical to SEQ ID NO: 108250
  derived and/or modified sequence opt2 from neuraminidase__InfluenzaA__ADZ04711

SEQ ID NO: 111947 - RNA, 1410 nt, Artificial Sequence
  derived and/or modified sequence opt2 from neuraminidase__InfluenzaA__ADZ05393
augaaccccaaccagaagaucaucaccaucgacuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111948 - RNA, 1413 nt, Artificial Sequence
  derived and/or modified sequence opt2 from neuraminidase__InfluenzaA__ADZ05837
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccugcgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaccaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111949 - RNA, 1413 nt, Artificial Sequence; identical to SEQ ID NO: 108973
  derived and/or modified sequence opt2 from neuraminidase__InfluenzaA__ADZ05848

SEQ ID NO: 111950 - RNA, 1410 nt, Artificial Sequence; identical to SEQ ID NO: 109417
  derived and/or modified sequence opt2 from neuraminidase__InfluenzaA__ADZ05858

SEQ ID NO: 111951 - RNA, 1410 nt, Artificial Sequence; identical to SEQ ID NO: 108250
  derived and/or modified sequence opt2 from neuraminidase__InfluenzaA__ADZ47841

SEQ ID NO: 111952 - RNA, 1410 nt, Artificial Sequence; identical to SEQ ID NO: 108250
  derived and/or modified sequence opt2 from neuraminidase__InfluenzaA__ADZ47851

SEQ ID NO: 111953 - RNA, 1410 nt, Artificial Sequence
  derived and/or modified sequence opt2 from neuraminidase__InfluenzaA__ADZ47861
augaaccccaaccagaagaucaucaccaucggcuccgucugcaugaccaucggccucgccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaucaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaagaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111954 - RNA, 1413 nt, Artificial Sequence
  derived and/or modified sequence opt2 from neuraminidase__InfluenzaA__ADZ53101
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaaggucgucgccggcgaggacaagaccuccgucacccucgccggcaacuccucccucugcuccaucuccggcugggccaucaacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 111955 - RNA, 1410 nt, Artificial Sequence
  derived and/or modified sequence opt2 from neuraminidase__InfluenzaA__ADZ53124
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111956 - RNA, 1410 nt, Artificial Sequence; identical to SEQ ID NO: 108250
  derived and/or modified sequence opt2 from neuraminidase__InfluenzaA__ADZ53130

SEQ ID NO: 111957 - RNA, 1410 nt, Artificial Sequence; identical to SEQ ID NO: 108240
  derived and/or modified sequence opt2 from neuraminidase__InfluenzaA__ADZ53132

SEQ ID NO: 111958 - RNA, 1410 nt, Artificial Sequence; identical to SEQ ID NO: 108250
  derived and/or modified sequence opt2 from neuraminidase__InfluenzaA__ADZ53134

SEQ ID NO: 111959 - RNA, 1410 nt, Artificial Sequence; identical to SEQ ID NO: 108250
  derived and/or modified sequence opt2 from neuraminidase__InfluenzaA__ADZ53136

SEQ ID NO: 111960 - RNA, 1410 nt, Artificial Sequence; identical to SEQ ID NO: 108604
  derived and/or modified sequence opt2 from neuraminidase__InfluenzaA__ADZ53137

SEQ ID NO: 111961 - RNA, 1410 nt, Artificial Sequence; identical to SEQ ID NO: 108250
  derived and/or modified sequence opt2 from neuraminidase__InfluenzaA__ADZ53139

SEQ ID NO: 111962 - RNA, 1410 nt, Artificial Sequence
  derived and/or modified sequence opt2 from neuraminidase__InfluenzaA__ADZ53141
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcacuccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 111963 - RNA, 1410 nt, Artificial Sequence; identical to SEQ ID NO: 108111
  derived and/or modified sequence opt2 from neuraminidase__InfluenzaA__AEA03712

SEQ ID NO: 111964 - RNA, 1410 nt, Artificial Sequence; identical to SEQ ID NO: 108111
  derived and/or modified sequence opt2 from neuraminidase__InfluenzaA__AEA03722

SEQ ID NO: 111965 - RNA, 1410 nt, Artificial Sequence; identical to SEQ ID NO: 108111
  derived and/or modified sequence opt2 from neuraminidase__InfluenzaA__AEA03744

SEQ ID NO: 111966 - RNA, 1410 nt, Artificial Sequence
  derived and/or modified sequence opt2 from neuraminidase__InfluenzaA__AEA03755
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111967 - RNA, 1410 nt, Artificial Sequence; identical to SEQ ID NO: 108111
  derived and/or modified sequence opt2 from neuraminidase__InfluenzaA__AEA03766

SEQ ID NO: 111968 - RNA, 1410 nt, Artificial Sequence; identical to SEQ ID NO: 108111
  derived and/or modified sequence opt2 from neuraminidase__InfluenzaA__AEA03796

SEQ ID NO: 111969 - RNA, 1410 nt, Artificial Sequence; identical to SEQ ID NO: 108111
  derived and/or modified sequence opt2 from neuraminidase__InfluenzaA__AEA03806

SEQ ID NO: 111970 - RNA, 1410 nt, Artificial Sequence
  derived and/or modified sequence opt2 from neuraminidase__InfluenzaA__AEA03817
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111971 - RNA, 1410 nt, Artificial Sequence; identical to SEQ ID NO: 108111
  derived and/or modified sequence opt2 from neuraminidase__InfluenzaA__AEA03828

SEQ ID NO: 111972 - RNA, 1410 nt, Artificial Sequence; identical to SEQ ID NO: 108111
  derived and/or modified sequence opt2 from neuraminidase__InfluenzaA__AEA03838

SEQ ID NO: 111973 - RNA, 1410 nt, Artificial Sequence; identical to SEQ ID NO: 111267
  derived and/or modified sequence opt2 from neuraminidase__InfluenzaA__AEA03849

SEQ ID NO: 111974 - RNA, 1410 nt, Artificial Sequence; identical to SEQ ID NO: 108111
  derived and/or modified sequence opt2 from neuraminidase__InfluenzaA__AEA03860

SEQ ID NO: 111975 - RNA, 1410 nt, Artificial Sequence
  derived and/or modified sequence opt2 from neuraminidase__InfluenzaA__AEA03871
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaucaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111976 - RNA, 1410 nt, Artificial Sequence; identical to SEQ ID NO: 108111
  derived and/or modified sequence opt2 from neuraminidase__InfluenzaA__AEA03879

SEQ ID NO: 111977 - RNA, 1410 nt, Artificial Sequence
  derived and/or modified sequence opt2 from neuraminidase__InfluenzaA__AEA03889
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaagguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111978 - RNA, 1410 nt, Artificial Sequence
  derived and/or modified sequence opt2 from neuraminidase__InfluenzaA__AEA03898
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaaguccgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111979 - RNA, 1410 nt, Artificial Sequence; identical to SEQ ID NO: 108111
  derived and/or modified sequence opt2 from neuraminidase__InfluenzaA__AEA03909

SEQ ID NO: 111980 - RNA, 1410 nt, Artificial Sequence
  derived and/or modified sequence opt2 from neuraminidase__InfluenzaA__AEA03924
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111981 - RNA, 1410 nt, Artificial Sequence; identical to SEQ ID NO: 108111
  derived and/or modified sequence opt2 from neuraminidase__InfluenzaA__AEA03935

SEQ ID NO: 111982 - RNA, 1410 nt, Artificial Sequence
  derived and/or modified sequence opt2 from neuraminidase__InfluenzaA__AEA03946
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccgaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111983 - RNA, 1410 nt, Artificial Sequence
  derived and/or modified sequence opt2 from neuraminidase__InfluenzaA__AEA03957
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaacuccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 111984 - RNA, 1410 nt, Artificial Sequence; identical to SEQ ID NO: 108111
  derived and/or modified sequence opt2 from neuraminidase__InfluenzaA__AEA03989

SEQ ID NO: 111985 - RNA, 1410 nt, Artificial Sequence; identical to SEQ ID NO: 111267
  derived and/or modified sequence opt2 from neuraminidase__InfluenzaA__AEA04000

SEQ ID NO: 111986 - RNA, 1410 nt, Artificial Sequence; identical to SEQ ID NO: 108111
  derived and/or modified sequence opt2 from neuraminidase__InfluenzaA__AEA04011

SEQ ID NO: 111987 - RNA, 1410 nt, Artificial Sequence; identical to SEQ ID NO: 111267
  derived and/or modified sequence opt2 from neuraminidase__InfluenzaA__AEA04022

SEQ ID NO: 111988 - RNA, 1410 nt, Artificial Sequence; identical to SEQ ID NO: 108111
  derived and/or modified sequence opt2 from neuraminidase__InfluenzaA__AEA04033

SEQ ID NO: 111989 - RNA, 1410 nt, Artificial Sequence; identical to SEQ ID NO: 108111
  derived and/or modified sequence opt2 from neuraminidase__InfluenzaA__AEA04044

SEQ ID NO: 111990 - RNA, 1410 nt, Artificial Sequence; identical to SEQ ID NO: 108111
  derived and/or modified sequence opt2 from neuraminidase__InfluenzaA__AEA04049

SEQ ID NO: 111991 - RNA, 1410 nt, Artificial Sequence; identical to SEQ ID NO: 108111
  derived and/or modified sequence opt2 from neuraminidase__InfluenzaA__AEA04059

SEQ ID NO: 111992 - RNA, 1410 nt, Artificial Sequence; identical to SEQ ID NO: 108111
  derived and/or modified sequence opt2 from neuraminidase__InfluenzaA__AEA04070

SEQ ID NO: 111993 - RNA, 1410 nt, Artificial Sequence; identical to SEQ ID NO: 111267
  derived and/or modified sequence opt2 from neuraminidase__InfluenzaA__AEA04081

SEQ ID NO: 111994 - RNA, 1410 nt, Artificial Sequence; identical to SEQ ID NO: 108111
  derived and/or modified sequence opt2 from neuraminidase__InfluenzaA__AEA04092

SEQ ID NO: 111995 - RNA, 1410 nt, Artificial Sequence; identical to SEQ ID NO: 108111
  derived and/or modified sequence opt2 from neuraminidase__InfluenzaA__AEA04103

SEQ ID NO: 111996 - RNA, 1410 nt, Artificial Sequence; identical to SEQ ID NO: 108111
  derived and/or modified sequence opt2 from neuraminidase__InfluenzaA__AEA04125

SEQ ID NO: 111997 - RNA, 1410 nt, Artificial Sequence; identical to SEQ ID NO: 108111
  derived and/or modified sequence opt2 from neuraminidase__InfluenzaA__AEA04133

SEQ ID NO: 111998 - RNA, 1410 nt, Artificial Sequence
  derived and/or modified sequence opt2 from neuraminidase__InfluenzaA__AEA04144
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucaucgucuucugcggcaccuccggcaccuacggcaccggcuccuggcccgacggcgccgacaucaaccucaugcccaucuga

SEQ ID NO: 111999 - RNA, 1410 nt, Artificial Sequence; identical to SEQ ID NO: 108111
  derived and/or modified sequence opt2 from neuraminidase__InfluenzaA__AEA04155

SEQ ID NO: 112000 - RNA, 1410 nt, Artificial Sequence; identical to SEQ ID NO: 108111
  derived and/or modified sequence opt2 from neuraminidase__InfluenzaA__AEA04166

SEQ ID NO: 112001 - RNA, 1410 nt, Artificial Sequence
  derived and/or modified sequence opt2 from neuraminidase__InfluenzaA__AEA04177
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112002 - RNA, 1410 nt, Artificial Sequence; identical to SEQ ID NO: 108111
  derived and/or modified sequence opt2 from neuraminidase__InfluenzaA__AEA04188

SEQ ID NO: 112003 - RNA, 1410 nt, Artificial Sequence; identical to SEQ ID NO: 109104
  derived and/or modified sequence opt2 from neuraminidase__InfluenzaA__AEA04199

SEQ ID NO: 112004 - RNA, 1410 nt, Artificial Sequence; identical to SEQ ID NO: 108111
  derived and/or modified sequence opt2 from neuraminidase__InfluenzaA__AEA04210

SEQ ID NO: 112005 - RNA, 1410 nt, Artificial Sequence; identical to SEQ ID NO: 109104
  derived and/or modified sequence opt2 from neuraminidase__InfluenzaA__AEA04229

SEQ ID NO: 112006 - RNA, 1410 nt, Artificial Sequence; identical to SEQ ID NO: 109104
  derived and/or modified sequence opt2 from neuraminidase__InfluenzaA__AEA04239

SEQ ID NO: 112007 - RNA, 1410 nt, Artificial Sequence
  derived and/or modified sequence opt2 from neuraminidase__InfluenzaA__AEA04250
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcguccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112008 - RNA, 1410 nt, Artificial Sequence; identical to SEQ ID NO: 109104
  derived and/or modified sequence opt2 from neuraminidase__InfluenzaA__AEA04260

SEQ ID NO: 112009 - RNA, 1410 nt, Artificial Sequence
  derived and/or modified sequence opt2 from neuraminidase__InfluenzaA__AEA04268
augaaccccaaccagaagaucaucaccaucggcuccgucucccucaccaucuccaccaucugccucuucaugcagaccgccauccucaucaccaccgucacccuccacuucaagcagugcgaguucaacuccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112010 - RNA, 1410 nt, Artificial Sequence; identical to SEQ ID NO: 109104
  derived and/or modified sequence opt2 from neuraminidase__InfluenzaA__AEA04276

SEQ ID NO: 112011 - RNA, 1410 nt, Artificial Sequence; identical to SEQ ID NO: 109104
  derived and/or modified sequence opt2 from neuraminidase__InfluenzaA__AEA04287

SEQ ID NO: 112012 - RNA, 1410 nt, Artificial Sequence; identical to SEQ ID NO: 109104
  derived and/or modified sequence opt2 from neuraminidase__InfluenzaA__AEA04298

SEQ ID NO: 112013 - RNA, 1410 nt, Artificial Sequence
  derived and/or modified sequence opt2 from neuraminidase__InfluenzaA__AEA04307
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccgacguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112014 - RNA, 1395 nt, Artificial Sequence
  derived and/or modified sequence opt2 from neuraminidase__InfluenzaA__AEA04357
augaaccccaaccagaagaucaucaccaucggcuccaucugcauggucgucggcaucaucucccucauccuccagaucggcaacaucgucuccaucuggaucucccacuccauccagaccggcaaccagaaccacaccggcaccugcgaccaguccaucaucaccuacaagaacuccaccugggucaaccagaccuacgucaacgucgucgccggcaaggacaccaccuccgucauccucgccggcaacuccucccucugccccauccgcggcugggccaucuacuccaaggacaacggcguccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacgacggcgccgucgccguccucaaguacaacggcaucaucaccgagaccaucaaguccuggcgcaaggagauccuccgcacccaggaguccgagugcgucugcgucaacggcuccugcuucaccaucaugaccgacggccccuccggcggccccgccuccuacaagaucuucaagaucgagaagggcaaggucaccaaguccaucgagcucgacgcccccaacucccacuacgaggagugcuccugcuaccccgacaccuccaaggucaugugcgucugccgcgacaacuggcacggcuccaaccgccccugggucuccuucgaccagaaccucgacuaccagaugggcuacaucugcuccggcgucuucggcgacaacccccgccccaaggacggcaagggcuccugcggccccgucuacgucgacggcgccaacggcgucaagggcuucuccuacaaguacggcaacggcgucuggaucggccgcaccaaguccaucuccucccgccagggcuucgagaugaucugggaccccaacggcuggaccgagaccgacuccaacuucuucaccaagcaggacgucgucgccgucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 112015 - RNA, 1410 nt, Artificial Sequence; identical to SEQ ID NO: 107979
  derived and/or modified sequence opt2 from neuraminidase__InfluenzaA__AEA04368

SEQ ID NO: 112016 - RNA, 1410 nt, Artificial Sequence
  derived and/or modified sequence opt2 from neuraminidase__InfluenzaA__AEA04379
augaaccccaaccagaagaccaucaccaucggcuccgucucccucaccaucgagaccgucugcuuccucaugcagaucgccauccucgccaccaccgucacccuccacuucaagcagcacgagugcgacucccccgccuccaaccaggucaugcccugcgagcccaucaucaucgagcgcaacaucaccgagaucgucuaccucaacaacaccaccaucgagaaggagaucugccccgaggucgucgaguaccgcaacugguccaagccccagugccagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacggcaccauccacgaccgcaucccccaccgcacccuccucaugaacgagcucggcguccccuuccaccucggcaccaagcaggucugcgucgccugguccuccuccuccugccacgacggcaaggccuggcuccacgucugcgucaccggcgacgaccgcaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucaaggagggcaagaucguccacaucuccccccucuccggcuccgcccagcacaucgaggagugcuccugcuacccccgcuaccccgacguccgcugcaucugccgcgacaacuggaagggcuccaaccgccccgucaucgacaucaacauggaggacuacuccaucgacuccuccuacgucugcuccggccucgucggcgacaccccccgcaacgacgacuccuccuccaacuccaagucccgcgaccccaacaacgagcgcggcaaccccggcgucaagggcugggccuucgacaacggcgacgacgucuggaugggccgcaccaucuccaaggacucccgcuccggcuacgagaccuucaaggucaucggcggcugguccacccccaacuccaagucccaggucaaccgccaggucaucgucgacaacaacaacugguccggcuacuccggcaucuucuccgucgagggcaaguccugcaucaaccgcugcuucuacgucgagcucauccgcggccgcccccaggagacccgcgucugguggaccuccaacuccaucgucgucuucugcggcaccuccggcaccuacggcaccggcuccuggcccgacggcgccaacaucaacuucaugcccaucuga

SEQ ID NO: 112017 - RNA, 1413 nt, Artificial Sequence; identical to SEQ ID NO: 111716
  derived and/or modified sequence opt2 from neuraminidase__InfluenzaA__AEA10295

SEQ ID NO: 112018 - RNA, 1410 nt, Artificial Sequence; identical to SEQ ID NO: 108250
  derived and/or modified sequence opt2 from neuraminidase__InfluenzaA__AEA10306

SEQ ID NO: 112019 - RNA, 1410 nt, Artificial Sequence; identical to SEQ ID NO: 111603
  derived and/or modified sequence opt2 from neuraminidase__InfluenzaA__AEA10316

SEQ ID NO: 112020 - RNA, 1410 nt, Artificial Sequence; identical to SEQ ID NO: 108250
  derived and/or modified sequence opt2 from neuraminidase__InfluenzaA__AEA10326

SEQ ID NO: 112021 - RNA, 1410 nt, Artificial Sequence; identical to SEQ ID NO: 109538
  derived and/or modified sequence opt2 from neuraminidase__InfluenzaA__AEA10335

SEQ ID NO: 112022 - RNA, 1410 nt, Artificial Sequence; identical to SEQ ID NO: 108250
  derived and/or modified sequence opt2 from neuraminidase__InfluenzaA__AEA10342

SEQ ID NO: 112023 - RNA, 1410 nt, Artificial Sequence
  derived and/or modified sequence opt2 from neuraminidase__InfluenzaA__AEA10352
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcaucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcucccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112024 - RNA, 1410 nt, Artificial Sequence; identical to SEQ ID NO: 108250
  derived and/or modified sequence opt2 from neuraminidase__InfluenzaA__AEA48991

SEQ ID NO: 112025 - RNA, 1410 nt, Artificial Sequence; identical to SEQ ID NO: 110922
  derived and/or modified sequence opt2 from neuraminidase__InfluenzaA__AEA72707

SEQ ID NO: 112026 - RNA, 1410 nt, Artificial Sequence; identical to SEQ ID NO: 110922
  derived and/or modified sequence opt2 from neuraminidase__InfluenzaA__AEA72718

SEQ ID NO: 112027 - RNA, 1410 nt, Artificial Sequence; identical to SEQ ID NO: 110922
  derived and/or modified sequence opt2 from neuraminidase__InfluenzaA__AEA72729

SEQ ID NO: 112028 - RNA, 1410 nt, Artificial Sequence
  derived and/or modified sequence opt2 from neuraminidase__InfluenzaA__AEA72742
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112029 - RNA, 1410 nt, Artificial Sequence; identical to SEQ ID NO: 110525
  derived and/or modified sequence opt2 from neuraminidase__InfluenzaA__AEA72779

SEQ ID NO: 112030 - RNA, 1410 nt, Artificial Sequence
  derived and/or modified sequence opt2 from neuraminidase__InfluenzaA__AEA72789
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacgacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112031 - RNA, 1410 nt, Artificial Sequence; identical to SEQ ID NO: 110922
  derived and/or modified sequence opt2 from neuraminidase__InfluenzaA__AEA73291

SEQ ID NO: 112032 - RNA, 1410 nt, Artificial Sequence; identical to SEQ ID NO: 110922
  derived and/or modified sequence opt2 from neuraminidase__InfluenzaA__AEA73302

SEQ ID NO: 112033 - RNA, 1410 nt, Artificial Sequence; identical to SEQ ID NO: 110922
  derived and/or modified sequence opt2 from neuraminidase__InfluenzaA__AEA73313

SEQ ID NO: 112034 - RNA, 1410 nt, Artificial Sequence; identical to SEQ ID NO: 110922
  derived and/or modified sequence opt2 from neuraminidase__InfluenzaA__AEA73324

SEQ ID NO: 112035 - RNA, 1410 nt, Artificial Sequence; identical to SEQ ID NO: 110922
  derived and/or modified sequence opt2 from neuraminidase__InfluenzaA__AEA73335

SEQ ID NO: 112036 - RNA, 1410 nt, Artificial Sequence; identical to SEQ ID NO: 110922
  derived and/or modified sequence opt2 from neuraminidase__InfluenzaA__AEA73346

SEQ ID NO: 112037 - RNA, 1410 nt, Artificial Sequence; identical to SEQ ID NO: 110922
  derived and/or modified sequence opt2 from neuraminidase__InfluenzaA__AEA73357

SEQ ID NO: 112038 - RNA, 1410 nt, Artificial Sequence; identical to SEQ ID NO: 110922
  derived and/or modified sequence opt2 from neuraminidase__InfluenzaA__AEA73368

SEQ ID NO: 112039 - RNA, 1410 nt, Artificial Sequence; identical to SEQ ID NO: 110922
  derived and/or modified sequence opt2 from neuraminidase__InfluenzaA__AEA73379

SEQ ID NO: 112040 - RNA, 1410 nt, Artificial Sequence; identical to SEQ ID NO: 110922
  derived and/or modified sequence opt2 from neuraminidase__InfluenzaA__AEA73390

SEQ ID NO: 112041 - RNA, 1410 nt, Artificial Sequence; identical to SEQ ID NO: 110922
  derived and/or modified sequence opt2 from neuraminidase__InfluenzaA__AEA73401

SEQ ID NO: 112042 - RNA, 1410 nt, Artificial Sequence; identical to SEQ ID NO: 110922
  derived and/or modified sequence opt2 from neuraminidase__InfluenzaA__AEA73412

SEQ ID NO: 112043 - RNA, 1410 nt, Artificial Sequence; identical to SEQ ID NO: 110922
  derived and/or modified sequence opt2 from neuraminidase__InfluenzaA__AEA73423

SEQ ID NO: 112044 - RNA, 1410 nt, Artificial Sequence; identical to SEQ ID NO: 110922
  derived and/or modified sequence opt2 from neuraminidase__InfluenzaA__AEA73455

SEQ ID NO: 112045 - RNA, 1410 nt, Artificial Sequence; identical to SEQ ID NO: 110922
  derived and/or modified sequence opt2 from neuraminidase__InfluenzaA__AEA73466

SEQ ID NO: 112046 - RNA, 1410 nt, Artificial Sequence
  derived and/or modified sequence opt2 from neuraminidase__InfluenzaA__AEA73477
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgaccucaaccucaugcccaucuga

SEQ ID NO: 112047 - RNA, 1410 nt, Artificial Sequence; identical to SEQ ID NO: 110922
  derived and/or modified sequence opt2 from neuraminidase__InfluenzaA__AEA73488

SEQ ID NO: 112048 - RNA, 1410 nt, Artificial Sequence
  derived and/or modified sequence opt2 from neuraminidase__InfluenzaA__AEA73499
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccaccaucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112049 - RNA, 1410 nt, Artificial Sequence; identical to SEQ ID NO: 110922
  derived and/or modified sequence opt2 from neuraminidase__InfluenzaA__AEA73510

SEQ ID NO: 112050 - RNA, 1410 nt, Artificial Sequence; identical to SEQ ID NO: 110922
  derived and/or modified sequence opt2 from neuraminidase__InfluenzaA__AEA73521

SEQ ID NO: 112051 - RNA, 1410 nt, Artificial Sequence; identical to SEQ ID NO: 110922
  derived and/or modified sequence opt2 from neuraminidase__InfluenzaA__AEA73532

SEQ ID NO: 112052 - RNA, 1410 nt, Artificial Sequence; identical to SEQ ID NO: 110922
  derived and/or modified sequence opt2 from neuraminidase__InfluenzaA__AEA73543

SEQ ID NO: 112053 - RNA, 1410 nt, Artificial Sequence; identical to SEQ ID NO: 110922
  derived and/or modified sequence opt2 from neuraminidase__InfluenzaA__AEA73554

SEQ ID NO: 112054 - RNA, 1410 nt, Artificial Sequence; identical to SEQ ID NO: 110922
  derived and/or modified sequence opt2 from neuraminidase__InfluenzaA__AEA73565

SEQ ID NO: 112055 - RNA, 1413 nt, Artificial Sequence; identical to SEQ ID NO: 108973
  derived and/or modified sequence opt2 from neuraminidase__InfluenzaA__AEA73576

SEQ ID NO: 112056 - RNA, 1413 nt, Artificial Sequence; identical to SEQ ID NO: 108973
  derived and/or modified sequence opt2 from neuraminidase__InfluenzaA__AEA73587

SEQ ID NO: 112057 - RNA, 1413 nt, Artificial Sequence; identical to SEQ ID NO: 111716
  derived and/or modified sequence opt2 from neuraminidase__InfluenzaA__AEA73598

SEQ ID NO: 112058 - RNA, 1413 nt, Artificial Sequence; identical to SEQ ID NO: 108973
  derived and/or modified sequence opt2 from neuraminidase__InfluenzaA__AEA73609

SEQ ID NO: 112059 - RNA, 1413 nt, Artificial Sequence; identical to SEQ ID NO: 108973
  derived and/or modified sequence opt2 from neuraminidase__InfluenzaA__AEA73620

SEQ ID NO: 112060 - RNA, 1413 nt, Artificial Sequence
  derived and/or modified sequence opt2 from neuraminidase__InfluenzaA__AEA73631
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaucaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112061 - RNA, 1413 nt, Artificial Sequence
  derived and/or modified sequence opt2 from neuraminidase__InfluenzaA__AEA73642
augaaccccaaccagcgcaucaucaccaucggcuccaucuccaucgccaucggcaucaucucccucaugcuccagaucggcaacaucaucuccaucugggccucccacuccauccagaccggcucccagaacaacaccggcaucugcaagcagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggcucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112062 - RNA, 1413 nt, Artificial Sequence; identical to SEQ ID NO: 108973
  derived and/or modified sequence opt2 from neuraminidase__InfluenzaA__AEA73653

SEQ ID NO: 112063 - RNA, 1413 nt, Artificial Sequence
  derived and/or modified sequence opt2 from neuraminidase__InfluenzaA__AEA73664
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 112064 - RNA, 1413 nt, Artificial Sequence
  derived and/or modified sequence opt2 from neuraminidase__InfluenzaA__AEA73675
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucuggaucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112065 - RNA, 1413 nt, Artificial Sequence; identical to SEQ ID NO: 111716
  derived and/or modified sequence opt2 from neuraminidase__InfluenzaA__AEA73686

SEQ ID NO: 112066 - RNA, 1413 nt, Artificial Sequence
  derived and/or modified sequence opt2 from neuraminidase__InfluenzaA__AEA73697
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacaucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccgucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112067 - RNA, 1413 nt, Artificial Sequence; identical to SEQ ID NO: 111717
  derived and/or modified sequence opt2 from neuraminidase__InfluenzaA__AEA73708

SEQ ID NO: 112068 - RNA, 1413 nt, Artificial Sequence; identical to SEQ ID NO: 108973
  derived and/or modified sequence opt2 from neuraminidase__InfluenzaA__AEA73719

SEQ ID NO: 112069 - RNA, 1413 nt, Artificial Sequence; identical to SEQ ID NO: 108973
  derived and/or modified sequence opt2 from neuraminidase__InfluenzaA__AEA73730

SEQ ID NO: 112070 - RNA, 1413 nt, Artificial Sequence; identical to SEQ ID NO: 108973
  derived and/or modified sequence opt2 from neuraminidase__InfluenzaA__AEA73741

SEQ ID NO: 112071 - RNA, 1413 nt, Artificial Sequence; identical to SEQ ID NO: 108973
  derived and/or modified sequence opt2 from neuraminidase__InfluenzaA__AEA73752

SEQ ID NO: 112072 - RNA, 1413 nt, Artificial Sequence; identical to SEQ ID NO: 111716
  derived and/or modified sequence opt2 from neuraminidase__InfluenzaA__AEA73763

SEQ ID NO: 112073 - RNA, 1410 nt, Artificial Sequence; identical to SEQ ID NO: 108250
  derived and/or modified sequence opt2 from neuraminidase__InfluenzaA__AEA73774

SEQ ID NO: 112074 - RNA, 1410 nt, Artificial Sequence; identical to SEQ ID NO: 108250
  derived and/or modified sequence opt2 from neuraminidase__InfluenzaA__AEA73784

SEQ ID NO: 112075 - RNA, 1410 nt, Artificial Sequence; identical to SEQ ID NO: 108250
  derived and/or modified sequence opt2 from neuraminidase__InfluenzaA__AEA73794

SEQ ID NO: 112076 - RNA, 1410 nt, Artificial Sequence; identical to SEQ ID NO: 108250
  derived and/or modified sequence opt2 from neuraminidase__InfluenzaA__AEA73804

SEQ ID NO: 112077 - RNA, 1410 nt, Artificial Sequence; identical to SEQ ID NO: 108250
  derived and/or modified sequence opt2 from neuraminidase__InfluenzaA__AEA73814

SEQ ID NO: 112078 - RNA, 1410 nt, Artificial Sequence; identical to SEQ ID NO: 108250
  derived and/or modified sequence opt2 from neuraminidase__InfluenzaA__AEA73824

SEQ ID NO: 112079 - RNA, 1410 nt, Artificial Sequence
  derived and/or modified sequence opt2 from neuraminidase__InfluenzaA__AEA73834
augaaccccaaccagaagaucaucaccaucggcuccaucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggaagaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112080 - RNA, 1410 nt, Artificial Sequence; identical to SEQ ID NO: 111612
  derived and/or modified sequence opt2 from neuraminidase__InfluenzaA__AEA73844

SEQ ID NO: 112081 - RNA, 1410 nt, Artificial Sequence; identical to SEQ ID NO: 108250
  derived and/or modified sequence opt2 from neuraminidase__InfluenzaA__AEA73854

SEQ ID NO: 112082 - RNA, 1410 nt, Artificial Sequence; identical to SEQ ID NO: 108250
  derived and/or modified sequence opt2 from neuraminidase__InfluenzaA__AEA73864

SEQ ID NO: 112083 - RNA, 1410 nt, Artificial Sequence; identical to SEQ ID NO: 110031
  derived and/or modified sequence opt2 from neuraminidase__InfluenzaA__AEA73874

SEQ ID NO: 112084 - RNA, 1410 nt, Artificial Sequence; identical to SEQ ID NO: 110031
  derived and/or modified sequence opt2 from neuraminidase__InfluenzaA__AEA73884

SEQ ID NO: 112085 - RNA, 1410 nt, Artificial Sequence; identical to SEQ ID NO: 111612
  derived and/or modified sequence opt2 from neuraminidase__InfluenzaA__AEA73894

SEQ ID NO: 112086 - RNA, 1410 nt, Artificial Sequence
  derived and/or modified sequence opt2 from neuraminidase__InfluenzaA__AEA73904
augaaccccaaccagaagaucaucaccaucggcuccgucugcaugaccaucggcauggccaaccucguccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaagaccaucuggaccuccggcuccuccaucuccuucugcggcgucaacuccgacaccgucggcugguccuggcccgacggcgccgagcuccccuucaccaucgacaaguga

SEQ ID NO: 112087 - RNA, 1410 nt, Artificial Sequence; identical to SEQ ID NO: 108250
  derived and/or modified sequence opt2 from neuraminidase__InfluenzaA__AEA73914

SEQ ID NO: 112088 - RNA, 1410 nt, Artificial Sequence; identical to SEQ ID NO: 110031
  derived and/or modified sequence opt2 from neuraminidase__InfluenzaA__AEA73924

SEQ ID NO: 112089 - RNA, 1410 nt, Artificial Sequence; identical to SEQ ID NO: 111689
  derived and/or modified sequence opt2 from neuraminidase__InfluenzaA__AEA73934

SEQ ID NO: 112090 - RNA, 1410 nt, Artificial Sequence
  derived and/or modified sequence opt2 from neuraminidase__InfluenzaA__AEA73944
augaaccccaaccagaagaucaucaccaucggcuccgucugcaugaccaucggcauggccaaccucauccuccaggucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112091 - RNA, 1410 nt, Artificial Sequence; identical to SEQ ID NO: 108250
  derived and/or modified sequence opt2 from neuraminidase__InfluenzaA__AEA73954

SEQ ID NO: 112092 - RNA, 1410 nt, Artificial Sequence; identical to SEQ ID NO: 108250
  derived and/or modified sequence opt2 from neuraminidase__InfluenzaA__AEA73964

SEQ ID NO: 112093 - RNA, 1410 nt, Artificial Sequence
  derived and/or modified sequence opt2 from neuraminidase__InfluenzaA__AEA73974
augaaccccaaccagaagaucaucaccaucggcuccgucugcaugaccaucggcauggccaaccucauccuccagaucggcaacaucaucuccaucuggaucucccacuccauccagcacggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112094 - RNA, 1410 nt, Artificial Sequence; identical to SEQ ID NO: 108250
  derived and/or modified sequence opt2 from neuraminidase__InfluenzaA__AEA73984

SEQ ID NO: 112095 - RNA, 1410 nt, Artificial Sequence; identical to SEQ ID NO: 109601
  derived and/or modified sequence opt2 from neuraminidase__InfluenzaA__AEA73994

SEQ ID NO: 112096 - RNA, 1410 nt, Artificial Sequence
  derived and/or modified sequence opt2 from neuraminidase__InfluenzaA__AEA74004
augaaccccaacaagaagaucaucaucaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112097 - RNA, 1410 nt, Artificial Sequence; identical to SEQ ID NO: 109427
  derived and/or modified sequence opt2 from neuraminidase__InfluenzaA__AEA74014

SEQ ID NO: 112098 - RNA, 1410 nt, Artificial Sequence; identical to SEQ ID NO: 109427
  derived and/or modified sequence opt2 from neuraminidase__InfluenzaA__AEA74024

SEQ ID NO: 112099 - RNA, 1410 nt, Artificial Sequence; identical to SEQ ID NO: 108250
  derived and/or modified sequence opt2 from neuraminidase__InfluenzaA__AEA74032

SEQ ID NO: 112100 - RNA, 1410 nt, Artificial Sequence; identical to SEQ ID NO: 108250
  derived and/or modified sequence opt2 from neuraminidase__InfluenzaA__AEA74034

SEQ ID NO: 112101 - RNA, 1410 nt, Artificial Sequence
  derived and/or modified sequence opt2 from neuraminidase__InfluenzaA__AEA77302
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacacccccaagaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112102 - RNA, 1410 nt, Artificial Sequence; identical to SEQ ID NO: 111769
  derived and/or modified sequence opt2 from neuraminidase__InfluenzaA__AEB21318

SEQ ID NO: 112103 - RNA, 1410 nt, Artificial Sequence
  derived and/or modified sequence opt2 from neuraminidase__InfluenzaA__AEB21328
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcuucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccauguccuucugcggcgucaacuccgacaccgucggcugguccuggcccgacggcgccgagcuccccuucaccaucgacaaguga

SEQ ID NO: 112104 - RNA, 1410 nt, Artificial Sequence; identical to SEQ ID NO: 111769
  derived and/or modified sequence opt2 from neuraminidase__InfluenzaA__AEB21340

SEQ ID NO: 112105 - RNA, 1410 nt, Artificial Sequence
  derived and/or modified sequence opt2 from neuraminidase__InfluenzaA__AEB21350
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaucucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112106 - RNA, 1410 nt, Artificial Sequence; identical to SEQ ID NO: 111769
  derived and/or modified sequence opt2 from neuraminidase__InfluenzaA__AEB21360

SEQ ID NO: 112107 - RNA, 1410 nt, Artificial Sequence; identical to SEQ ID NO: 109117
  derived and/or modified sequence opt2 from neuraminidase__InfluenzaA__AEB40209

SEQ ID NO: 112108 - RNA, 1410 nt, Artificial Sequence; identical to SEQ ID NO: 108111
  derived and/or modified sequence opt2 from neuraminidase__InfluenzaA__AEB66898

SEQ ID NO: 112109 - RNA, 1413 nt, Artificial Sequence
  derived and/or modified sequence opt2 from neuraminidase__InfluenzaA__AEB71103
augaaccccaaccagaagaucaucaccaucggcuccgucucccucggccucgucgucuucaacguccuccuccacgucgucuccaucaucgucaccgucgucguccucggcaacgacggcggcaacggcaucugcaacggcaccgucgucaaggaguacaacgagaccguccgcaucgagcgcgucauccaguggcacaacaccuccgucgucgaguacauccccuaccucaacggcggcaccuacaccaacaacaccgaguccgucugcgacgucaagggcuucgcccccuucuccaaggacaacggcguccgcaucggcucccgcggccacgucuucgucauccgcgagcccuucgucuccugcuccccccgcgagugccgcaccuucuuccucacccagggcucccuccucaacgacaagcacuccaacggcaccgucaaggaccgcucccccuucaagacccucauguccgucgaggucggccagucccccaacgucuaccaggcccgcuucgaggccgucgccugguccgccaccgccugccacgacggcaagaaguggaugaccaucggcgucaccggccccgacuccaaggccgucgccgucguccacuacggcggcguccccaccgacaucaucaacuccugggccggcgacauccuccgcacccaggaguccuccugcaccugcauccagggcgacugcuacugggucaugaccgacggccccgccaaccgccaggcccaguaccgcaucuacaaguccaaccagggcaagaucaucggccagauggacaucaacuucaacggcggccacaucgaggagugcuccugcuaccccaacgacggcaaggucgagugcgucugccgcgacaacuggaccggcaccaaccgccccguccucgucaucucccccgaccucuccuacaaggucggcuaccucugcgccggccuccccuccgacaccccccgcggcgaggacgcccaguucuccggcuccugcaccucccccgucggcggccagggcuacggcgucaagggcuucggcuuccgccagggcaacgacgucuggaugggccgcaccaucucccgcaccucccgcuccggcuucgaggucauccgcgucaagaacggcuggacccagaccuccaaggagcagauccgcaagcaggucgucgucgacaaccucaacugguccggcuacuccggcuccuucacccuccccaucgagcucuccggcaaguccugccucguccccugcuucugggucgagaccauccgcggcaagcccgaggagaagaccaucuggaccuccuccuccuccaucgucaugugcggcgucgacuacgaggucgccgacugguccuggcacgacggcgccauccuccccuucgacaucgacaagauguga

SEQ ID NO: 112110 - RNA, 1413 nt, Artificial Sequence; identical to SEQ ID NO: 110442
  derived and/or modified sequence opt2 from neuraminidase__InfluenzaA__AEB71899

SEQ ID NO: 112111 - RNA, 1410 nt, Artificial Sequence
  derived and/or modified sequence opt2 from neuraminidase__InfluenzaA__AEB71910
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccuacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112112 - RNA, 1410 nt, Artificial Sequence; identical to SEQ ID NO: 108250
  derived and/or modified sequence opt2 from neuraminidase__InfluenzaA__AEB71919

SEQ ID NO: 112113 - RNA, 1410 nt, Artificial Sequence; identical to SEQ ID NO: 109996
  derived and/or modified sequence opt2 from neuraminidase__InfluenzaA__AEB71928

SEQ ID NO: 112114 - RNA, 1410 nt, Artificial Sequence
  derived and/or modified sequence opt2 from neuraminidase__InfluenzaA__AEB71939
augaaccccaaccagaagaucaucaccaucggcuccgucucccucaccaucuccgccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112115 - RNA, 1410 nt, Artificial Sequence
  derived and/or modified sequence opt2 from neuraminidase__InfluenzaA__AEB71950
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112116 - RNA, 1413 nt, Artificial Sequence; identical to SEQ ID NO: 111449
  derived and/or modified sequence opt2 from neuraminidase__InfluenzaA__AEB71961

SEQ ID NO: 112117 - RNA, 1410 nt, Artificial Sequence
  derived and/or modified sequence opt2 from neuraminidase__InfluenzaA__AEB71972
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgucaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112118 - RNA, 1410 nt, Artificial Sequence
  derived and/or modified sequence opt2 from neuraminidase__InfluenzaA__AEB71983
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgccgcaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112119 - RNA, 1413 nt, Artificial Sequence
  derived and/or modified sequence opt2 from neuraminidase__InfluenzaA__AEB71995
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacaucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucaacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgagugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112120 - RNA, 1413 nt, Artificial Sequence; identical to SEQ ID NO: 111717
  derived and/or modified sequence opt2 from neuraminidase__InfluenzaA__AEC13316

SEQ ID NO: 112121 - RNA, 1410 nt, Artificial Sequence; identical to SEQ ID NO: 108250
  derived and/or modified sequence opt2 from neuraminidase__InfluenzaA__AEC53262

SEQ ID NO: 112122 - RNA, 1410 nt, Artificial Sequence; identical to SEQ ID NO: 108250
  derived and/or modified sequence opt2 from neuraminidase__InfluenzaA__AEC53272

SEQ ID NO: 112123 - RNA, 1410 nt, Artificial Sequence; identical to SEQ ID NO: 108250
  derived and/or modified sequence opt2 from neuraminidase__InfluenzaA__AEC53282

SEQ ID NO: 112124 - RNA, 1410 nt, Artificial Sequence; identical to SEQ ID NO: 108250
  derived and/or modified sequence opt2 from neuraminidase__InfluenzaA__AEC53292

SEQ ID NO: 112125 - RNA, 1410 nt, Artificial Sequence
  derived and/or modified sequence opt2 from neuraminidase__InfluenzaA__AEC53302
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaucaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112126 - RNA, 1410 nt, Artificial Sequence; identical to SEQ ID NO: 108250
  derived and/or modified sequence opt2 from neuraminidase__InfluenzaA__AEC53350

SEQ ID NO: 112127 - RNA, 1410 nt, Artificial Sequence; identical to SEQ ID NO: 108958
  derived and/or modified sequence opt2 from neuraminidase__InfluenzaA__AEC53407

SEQ ID NO: 112128 - RNA, 1410 nt, Artificial Sequence; identical to SEQ ID NO: 108250
  derived and/or modified sequence opt2 from neuraminidase__InfluenzaA__AEC53427

SEQ ID NO: 112129 - RNA, 1410 nt, Artificial Sequence; identical to SEQ ID NO: 109076
  derived and/or modified sequence opt2 from neuraminidase__InfluenzaA__AED99967

SEQ ID NO: 112130 - RNA, 1410 nt, Artificial Sequence; identical to SEQ ID NO: 108240
  derived and/or modified sequence opt2 from neuraminidase__InfluenzaA__AEE27161

SEQ ID NO: 112131 - RNA, 1410 nt, Artificial Sequence; identical to SEQ ID NO: 108250
  derived and/or modified sequence opt2 from neuraminidase__InfluenzaA__AEE27170

SEQ ID NO: 112132 - RNA, 1410 nt, Artificial Sequence; identical to SEQ ID NO: 108240
  derived and/or modified sequence opt2 from neuraminidase__InfluenzaA__AEE27180

SEQ ID NO: 112133 - RNA, 1410 nt, Artificial Sequence
  derived and/or modified sequence opt2 from neuraminidase__InfluenzaA__AEE27190
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcgucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112134 - RNA, 1410 nt, Artificial Sequence; identical to SEQ ID NO: 109473
  derived and/or modified sequence opt2 from neuraminidase__InfluenzaA__AEE27200

SEQ ID NO: 112135 - RNA, 1410 nt, Artificial Sequence; identical to SEQ ID NO: 111309
  derived and/or modified sequence opt2 from neuraminidase__InfluenzaA__AEG64755

SEQ ID NO: 112136 - RNA, 1362 nt, Artificial Sequence
  derived and/or modified sequence opt2 from neuraminidase__InfluenzaA__AEG64765
augaaccccaaccagaagaucaucaccaucggcuccaucugcauggucgucggcaucaucucccucauccuccagaucggcaacaucaucuccaucuggaucucccacuccauccagaccggcaaccagaaccacaccggcaucugcaaccagggcaucaucaccuacaacgucgucgccggccaggacuccaccuccgucauccucaccggcaacuccucccucugccccauccgcggcugggccauccacuccaaggacaacggcauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugccccgucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggcgcaagaagauccuccgcacccaggaguccgagugcaccugcgucaacggcuccugcuucaccaucaugaccgacggccccuccgacggccucgccuccuacaagaucuucaagaucgagaagggcaaggucaccaaguccaucgagcucaacgcccccaacucccacuacgaggagugcuccugcuaccccgacaccggcaaggucaugugcgucugccgcgacaacuggcacggcuccaaccgccccugggucuccuucgaccagaaccucgacuaccagaucggcuacaucugcuccggcgucuucggcgacaacccccgccccaaggacggcaccggcuccugcggccccgucuccgccgacggcgccaacggcgucaagggcuucuccuaccgcuacggcaacggcgucuggaucggccgcaccaaguccgacuccucccgccacggcuucgagaugaucugggaccccaacggcuggaccgagaccgacucccgcuucuccguccgccaggacgucgucgccaugaccgaccgcuccggcuacuccggcuccuucguccagcaccccgagcucaccggccucgacugcaugcgccccugcuucugggucgagcucauccgcggccgccccgaggagaagaccaucuggaccuccggcuccaucaucuccuucugcggcgucaacuccgacaccgucgacugguccuggcccgacggcgccgagcuccccuucaccaucgacaaguga

SEQ ID NO: 112137 - RNA, 1410 nt, Artificial Sequence
  derived and/or modified sequence opt2 from neuraminidase__InfluenzaA__AEG64787
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaaccgccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacgacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112138 - RNA, 1410 nt, Artificial Sequence
  derived and/or modified sequence opt2 from neuraminidase__InfluenzaA__AEG64837
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccucccucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112139 - RNA, 1410 nt, Artificial Sequence
  derived and/or modified sequence opt2 from neuraminidase__InfluenzaA__AEG64848
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacuggcucaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaacaagcaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112140 - RNA, 1410 nt, Artificial Sequence; identical to SEQ ID NO: 105745
  derived and/or modified sequence opt2 from neuraminidase__InfluenzaA__AEG64859

SEQ ID NO: 112141 - RNA, 1410 nt, Artificial Sequence; identical to SEQ ID NO: 105573
  derived and/or modified sequence opt2 from neuraminidase__InfluenzaA__AEG64870

SEQ ID NO: 112142 - RNA, 1410 nt, Artificial Sequence; identical to SEQ ID NO: 105765
  derived and/or modified sequence opt2 from neuraminidase__InfluenzaA__AEG64881

SEQ ID NO: 112143 - RNA, 1410 nt, Artificial Sequence; identical to SEQ ID NO: 105573
  derived and/or modified sequence opt2 from neuraminidase__InfluenzaA__AEG64892

SEQ ID NO: 112144 - RNA, 1410 nt, Artificial Sequence; identical to SEQ ID NO: 105649
  derived and/or modified sequence opt2 from neuraminidase__InfluenzaA__AEG64914

SEQ ID NO: 112145 - RNA, 1410 nt, Artificial Sequence; identical to SEQ ID NO: 105649
  derived and/or modified sequence opt2 from neuraminidase__InfluenzaA__AEG64925

SEQ ID NO: 112146 - RNA, 1410 nt, Artificial Sequence
  derived and/or modified sequence opt2 from neuraminidase__InfluenzaA__AEG64936
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgaggacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 112147 - RNA, 1410 nt, Artificial Sequence; identical to SEQ ID NO: 105662
  derived and/or modified sequence opt2 from neuraminidase__InfluenzaA__AEG64947

SEQ ID NO: 112148 - RNA, 1410 nt, Artificial Sequence; identical to SEQ ID NO: 105649
  derived and/or modified sequence opt2 from neuraminidase__InfluenzaA__AEG64958

SEQ ID NO: 112149 - RNA, 1410 nt, Artificial Sequence; identical to SEQ ID NO: 105649
  derived and/or modified sequence opt2 from neuraminidase__InfluenzaA__AEG64969

SEQ ID NO: 112150 - RNA, 1410 nt, Artificial Sequence; identical to SEQ ID NO: 105649
  derived and/or modified sequence opt2 from neuraminidase__InfluenzaA__AEG64980

SEQ ID NO: 112151 - RNA, 1410 nt, Artificial Sequence
  derived and/or modified sequence opt2 from neuraminidase__InfluenzaA__AEG64991
augaaccccaaccagaagaucaucaccaucggcuccgucucccucaccaucuccaccaucugcuucuucaugcagaucgccauccucaucaccaccgucacccuccacuucaagcaguacgaguccaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112152 - RNA, 1410 nt, Artificial Sequence; identical to SEQ ID NO: 105839
  derived and/or modified sequence opt2 from neuraminidase__InfluenzaA__AEG65002

SEQ ID NO: 112153 - RNA, 1410 nt, Artificial Sequence
  derived and/or modified sequence opt2 from neuraminidase__InfluenzaA__AEG65013
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112154 - RNA, 1410 nt, Artificial Sequence
  derived and/or modified sequence opt2 from neuraminidase__InfluenzaA__AEG65024
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccacgucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112155 - RNA, 1410 nt, Artificial Sequence
  derived and/or modified sequence opt2 from neuraminidase__InfluenzaA__AEG65035
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccucgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 112156 - RNA, 1410 nt, Artificial Sequence; identical to SEQ ID NO: 106224
  derived and/or modified sequence opt2 from neuraminidase__InfluenzaA__AEG65057

SEQ ID NO: 112157 - RNA, 1410 nt, Artificial Sequence; identical to SEQ ID NO: 107219
  derived and/or modified sequence opt2 from neuraminidase__InfluenzaA__AEG65068

SEQ ID NO: 112158 - RNA, 1410 nt, Artificial Sequence
  derived and/or modified sequence opt2 from neuraminidase__InfluenzaA__AEG65079
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgccaagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112159 - RNA, 1410 nt, Artificial Sequence
  derived and/or modified sequence opt2 from neuraminidase__InfluenzaA__AEG65090
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucucccucaugcccaucuga

SEQ ID NO: 112160 - RNA, 1410 nt, Artificial Sequence
  derived and/or modified sequence opt2 from neuraminidase__InfluenzaA__AEG65101
augaaccccaaccagaagaucaucaccaucggcuccgucucccucaccaucuccaccaucugcuucuucaugcagaucgccauccucaucaccaccgucacccuccacuucaagcaguacgaguucaacuccccccccgacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112161 - RNA, 1410 nt, Artificial Sequence
  derived and/or modified sequence opt2 from neuraminidase__InfluenzaA__AEG65123
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaccaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaagaacuacuccaucgucuccuccuacgucugcuccggccucgucggcgacaccccccgcaagaccgacuccuccuccuccucccacugccucgaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 112162 - RNA, 1410 nt, Artificial Sequence; identical to SEQ ID NO: 107219
  derived and/or modified sequence opt2 from neuraminidase__InfluenzaA__AEG65134

SEQ ID NO: 112163 - RNA, 1410 nt, Artificial Sequence
  derived and/or modified sequence opt2 from neuraminidase__InfluenzaA__AEG65145
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccaacucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 112164 - RNA, 1410 nt, Artificial Sequence
  derived and/or modified sequence opt2 from neuraminidase__InfluenzaA__AEG65156
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 112165 - RNA, 1410 nt, Artificial Sequence
  derived and/or modified sequence opt2 from neuraminidase__InfluenzaA__AEG65167
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccgccacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 112166 - RNA, 1410 nt, Artificial Sequence
  derived and/or modified sequence opt2 from neuraminidase__InfluenzaA__AEG65178
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacaacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 112167 - RNA, 1410 nt, Artificial Sequence
  derived and/or modified sequence opt2 from neuraminidase__InfluenzaA__AEG65189
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaacgacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112168 - RNA, 1410 nt, Artificial Sequence
  derived and/or modified sequence opt2 from neuraminidase__InfluenzaA__AEG65200
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagguccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112169 - RNA, 1410 nt, Artificial Sequence; identical to SEQ ID NO: 106224
  derived and/or modified sequence opt2 from neuraminidase__InfluenzaA__AEG65211

SEQ ID NO: 112170 - RNA, 1410 nt, Artificial Sequence; identical to SEQ ID NO: 106226
  derived and/or modified sequence opt2 from neuraminidase__InfluenzaA__AEG65222

SEQ ID NO: 112171 - RNA, 1410 nt, Artificial Sequence
  derived and/or modified sequence opt2 from neuraminidase__InfluenzaA__AEG65233
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucaucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112172 - RNA, 1410 nt, Artificial Sequence
  derived and/or modified sequence opt2 from neuraminidase__InfluenzaA__AEG65244
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcacccagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 112173 - RNA, 1410 nt, Artificial Sequence; identical to SEQ ID NO: 106226
  derived and/or modified sequence opt2 from neuraminidase__InfluenzaA__AEG65255

SEQ ID NO: 112174 - RNA, 1410 nt, Artificial Sequence; identical to SEQ ID NO: 106103
  derived and/or modified sequence opt2 from neuraminidase__InfluenzaA__AEG65266

SEQ ID NO: 112175 - RNA, 1410 nt, Artificial Sequence; identical to SEQ ID NO: 106103
  derived and/or modified sequence opt2 from neuraminidase__InfluenzaA__AEG65277

SEQ ID NO: 112176 - RNA, 1410 nt, Artificial Sequence
  derived and/or modified sequence opt2 from neuraminidase__InfluenzaA__AEG65288
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacaacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 112177 - RNA, 1410 nt, Artificial Sequence; identical to SEQ ID NO: 106103
  derived and/or modified sequence opt2 from neuraminidase__InfluenzaA__AEG65299

SEQ ID NO: 112178 - RNA, 1410 nt, Artificial Sequence; identical to SEQ ID NO: 106226
  derived and/or modified sequence opt2 from neuraminidase__InfluenzaA__AEG65310

SEQ ID NO: 112179 - RNA, 1410 nt, Artificial Sequence; identical to SEQ ID NO: 106226
  derived and/or modified sequence opt2 from neuraminidase__InfluenzaA__AEG65321

SEQ ID NO: 112180 - RNA, 1410 nt, Artificial Sequence; identical to SEQ ID NO: 106226
  derived and/or modified sequence opt2 from neuraminidase__InfluenzaA__AEG65332

SEQ ID NO: 112181 - RNA, 1410 nt, Artificial Sequence; identical to SEQ ID NO: 106226
  derived and/or modified sequence opt2 from neuraminidase__InfluenzaA__AEG65354

SEQ ID NO: 112182 - RNA, 1410 nt, Artificial Sequence; identical to SEQ ID NO: 106226
  derived and/or modified sequence opt2 from neuraminidase__InfluenzaA__AEG65365

SEQ ID NO: 112183 - RNA, 1410 nt, Artificial Sequence
  derived and/or modified sequence opt2 from neuraminidase__InfluenzaA__AEG65376
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcacccagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 112184 - RNA, 1410 nt, Artificial Sequence; identical to SEQ ID NO: 106103
  derived and/or modified sequence opt2 from neuraminidase__InfluenzaA__AEG65387

SEQ ID NO: 112185 - RNA, 1410 nt, Artificial Sequence; identical to SEQ ID NO: 106103
  derived and/or modified sequence opt2 from neuraminidase__InfluenzaA__AEG65398

SEQ ID NO: 112186 - RNA, 1410 nt, Artificial Sequence; identical to SEQ ID NO: 106103
  derived and/or modified sequence opt2 from neuraminidase__InfluenzaA__AEG65409

SEQ ID NO: 112187 - RNA, 1410 nt, Artificial Sequence; identical to SEQ ID NO: 106103
  derived and/or modified sequence opt2 from neuraminidase__InfluenzaA__AEG65420

SEQ ID NO: 112188 - RNA, 1410 nt, Artificial Sequence; identical to SEQ ID NO: 106103
  derived and/or modified sequence opt2 from neuraminidase__InfluenzaA__AEG65431

SEQ ID NO: 112189 - RNA, 1410 nt, Artificial Sequence; identical to SEQ ID NO: 106224
  derived and/or modified sequence opt2 from neuraminidase__InfluenzaA__AEG65442

SEQ ID NO: 112190 - RNA, 1410 nt, Artificial Sequence; identical to SEQ ID NO: 106226
  derived and/or modified sequence opt2 from neuraminidase__InfluenzaA__AEG65453

SEQ ID NO: 112191 - RNA, 1410 nt, Artificial Sequence; identical to SEQ ID NO: 106226
  derived and/or modified sequence opt2 from neuraminidase__InfluenzaA__AEG65464

SEQ ID NO: 112192 - RNA, 1410 nt, Artificial Sequence; identical to SEQ ID NO: 106226
  derived and/or modified sequence opt2 from neuraminidase__InfluenzaA__AEG65475

SEQ ID NO: 112193 - RNA, 1410 nt, Artificial Sequence
  derived and/or modified sequence opt2 from neuraminidase__InfluenzaA__AEG65486
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgagcaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112194 - RNA, 1410 nt, Artificial Sequence; identical to SEQ ID NO: 106226
  derived and/or modified sequence opt2 from neuraminidase__InfluenzaA__AEG65497

SEQ ID NO: 112195 - RNA, 1410 nt, Artificial Sequence; identical to SEQ ID NO: 106226
  derived and/or modified sequence opt2 from neuraminidase__InfluenzaA__AEG65508

SEQ ID NO: 112196 - RNA, 1410 nt, Artificial Sequence; identical to SEQ ID NO: 106226
  derived and/or modified sequence opt2 from neuraminidase__InfluenzaA__AEG65519

SEQ ID NO: 112197 - RNA, 1410 nt, Artificial Sequence; identical to SEQ ID NO: 106226
  derived and/or modified sequence opt2 from neuraminidase__InfluenzaA__AEG65530

SEQ ID NO: 112198 - RNA, 1410 nt, Artificial Sequence; identical to SEQ ID NO: 106226
  derived and/or modified sequence opt2 from neuraminidase__InfluenzaA__AEG65541

SEQ ID NO: 112199 - RNA, 1410 nt, Artificial Sequence
  derived and/or modified sequence opt2 from neuraminidase__InfluenzaA__AEG65563
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112200 - RNA, 1410 nt, Artificial Sequence
  derived and/or modified sequence opt2 from neuraminidase__InfluenzaA__AEG65574
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcuccugguccaagccccagugcgacaucaccggcuucgcccccuucuccaaggacaacuccauccgccucuccgccggcggcgacaucugggucacccgcgagcccuacgucuccugcgaccccgaccgcugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112201 - RNA, 1410 nt, Artificial Sequence; identical to SEQ ID NO: 112199
  derived and/or modified sequence opt2 from neuraminidase__InfluenzaA__AEG65585

SEQ ID NO: 112202 - RNA, 1410 nt, Artificial Sequence; identical to SEQ ID NO: 112199
  derived and/or modified sequence opt2 from neuraminidase__InfluenzaA__AEG65596

SEQ ID NO: 112203 - RNA, 1410 nt, Artificial Sequence
  derived and/or modified sequence opt2 from neuraminidase__InfluenzaA__AEG65607
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112204 - RNA, 1410 nt, Artificial Sequence
  derived and/or modified sequence opt2 from neuraminidase__InfluenzaA__AEG65629
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacgacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaucgagguccucuggaccuccaacuccaucgucgucuucugcggcaccuccggcaccuacggcaccggcuccuggcccgacggcgccgacaucaaccucaugcccaucuga

SEQ ID NO: 112205 - RNA, 1410 nt, Artificial Sequence; identical to SEQ ID NO: 112204
  derived and/or modified sequence opt2 from neuraminidase__InfluenzaA__AEG65640

SEQ ID NO: 112206 - RNA, 1410 nt, Artificial Sequence; identical to SEQ ID NO: 105647
  derived and/or modified sequence opt2 from neuraminidase__InfluenzaA__AEG65651

SEQ ID NO: 112207 - RNA, 1410 nt, Artificial Sequence; identical to SEQ ID NO: 106226
  derived and/or modified sequence opt2 from neuraminidase__InfluenzaA__AEG65662

SEQ ID NO: 112208 - RNA, 1410 nt, Artificial Sequence; identical to SEQ ID NO: 106226
  derived and/or modified sequence opt2 from neuraminidase__InfluenzaA__AEG65673

SEQ ID NO: 112209 - RNA, 1410 nt, Artificial Sequence; identical to SEQ ID NO: 106226
  derived and/or modified sequence opt2 from neuraminidase__InfluenzaA__AEG65684

SEQ ID NO: 112210 - RNA, 1410 nt, Artificial Sequence; identical to SEQ ID NO: 112183
  derived and/or modified sequence opt2 from neuraminidase__InfluenzaA__AEG65695

SEQ ID NO: 112211 - RNA, 1410 nt, Artificial Sequence
  derived and/or modified sequence opt2 from neuraminidase__InfluenzaA__AEG65706
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgacaucaaccucaugcccaucuga

SEQ ID NO: 112212 - RNA, 1410 nt, Artificial Sequence
  derived and/or modified sequence opt2 from neuraminidase__InfluenzaA__AEG65728
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgagaucaaccucaugcccaucuga

SEQ ID NO: 112213 - RNA, 1410 nt, Artificial Sequence
  derived and/or modified sequence opt2 from neuraminidase__InfluenzaA__AEG65739
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcccugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112214 - RNA, 1410 nt, Artificial Sequence; identical to SEQ ID NO: 108076
  derived and/or modified sequence opt2 from neuraminidase__InfluenzaA__AEG65750

SEQ ID NO: 112215 - RNA, 1410 nt, Artificial Sequence; identical to SEQ ID NO: 112212
  derived and/or modified sequence opt2 from neuraminidase__InfluenzaA__AEG65761

SEQ ID NO: 112216 - RNA, 1410 nt, Artificial Sequence
  derived and/or modified sequence opt2 from neuraminidase__InfluenzaA__AEG65772
augaaccccaaccagaagaucaucaccaucggcuccgucucccucaccaucuccaccaucugcuucuucaugcagaccgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112217 - RNA, 1410 nt, Artificial Sequence; identical to SEQ ID NO: 111030
  derived and/or modified sequence opt2 from neuraminidase__InfluenzaA__AEG65783

SEQ ID NO: 112218 - RNA, 1410 nt, Artificial Sequence
  derived and/or modified sequence opt2 from neuraminidase__InfluenzaA__AEG65794
augaaccccaaccagaagaucaucaccaucggcuccgucucccucaccaucuccaccaucugcuucuucaugcagaucgccauccucaucaccaccaucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112219 - RNA, 1410 nt, Artificial Sequence; identical to SEQ ID NO: 111030
  derived and/or modified sequence opt2 from neuraminidase__InfluenzaA__AEG65805

SEQ ID NO: 112220 - RNA, 1410 nt, Artificial Sequence
  derived and/or modified sequence opt2 from neuraminidase__InfluenzaA__AEG65816
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112221 - RNA, 1410 nt, Artificial Sequence
  derived and/or modified sequence opt2 from neuraminidase__InfluenzaA__AEG79808
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112222 - RNA, 1410 nt, Artificial Sequence; identical to SEQ ID NO: 112221
  derived and/or modified sequence opt2 from neuraminidase__InfluenzaA__AEG79814

SEQ ID NO: 112223 - RNA, 1410 nt, Artificial Sequence
  derived and/or modified sequence opt2 from neuraminidase__InfluenzaA__AEG79826
augaaccccaaccagaagaucaucaccaucuccuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccaugggcugguccuggcccgacggcgccgagcuccccuucaccaucgacaaguga

SEQ ID NO: 112224 - RNA, 1410 nt, Artificial Sequence
  derived and/or modified sequence opt2 from neuraminidase__InfluenzaA__AEG79830
augaaccccaaccagaagaucaucaccaucuccuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112225 - RNA, 1410 nt, Artificial Sequence; identical to SEQ ID NO: 111769
  derived and/or modified sequence opt2 from neuraminidase__InfluenzaA__AEG79836

SEQ ID NO: 112226 - RNA, 1410 nt, Artificial Sequence
  derived and/or modified sequence opt2 from neuraminidase__InfluenzaA__AEH59356
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcacccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 112227 - RNA, 1410 nt, Artificial Sequence; identical to SEQ ID NO: 112221
  derived and/or modified sequence opt2 from neuraminidase__InfluenzaA__AEH59360

SEQ ID NO: 112228 - RNA, 1410 nt, Artificial Sequence
  derived and/or modified sequence opt2 from neuraminidase__InfluenzaA__AEH59364
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcgccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112229 - RNA, 1410 nt, Artificial Sequence
  derived and/or modified sequence opt2 from neuraminidase__InfluenzaA__AEH59366
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcggcguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112230 - RNA, 1410 nt, Artificial Sequence; identical to SEQ ID NO: 112221
  derived and/or modified sequence opt2 from neuraminidase__InfluenzaA__AEH59368

SEQ ID NO: 112231 - RNA, 1410 nt, Artificial Sequence; identical to SEQ ID NO: 111769
  derived and/or modified sequence opt2 from neuraminidase__InfluenzaA__AEH59370

SEQ ID NO: 112232 - RNA, 1410 nt, Artificial Sequence; identical to SEQ ID NO: 112228
  derived and/or modified sequence opt2 from neuraminidase__InfluenzaA__AEH59372

SEQ ID NO: 112233 - RNA, 1410 nt, Artificial Sequence; identical to SEQ ID NO: 112228
  derived and/or modified sequence opt2 from neuraminidase__InfluenzaA__AEH59376

SEQ ID NO: 112234 - RNA, 1410 nt, Artificial Sequence; identical to SEQ ID NO: 111769
  derived and/or modified sequence opt2 from neuraminidase__InfluenzaA__AEH59378

SEQ ID NO: 112235 - RNA, 1410 nt, Artificial Sequence; identical to SEQ ID NO: 112228
  derived and/or modified sequence opt2 from neuraminidase__InfluenzaA__AEH59382

SEQ ID NO: 112236 - RNA, 1410 nt, Artificial Sequence
  derived and/or modified sequence opt2 from neuraminidase__InfluenzaA__AEH59384
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggccgcaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112237 - RNA, 1410 nt, Artificial Sequence
  derived and/or modified sequence opt2 from neuraminidase__InfluenzaA__AEH59386
augaaccccaaccagaagaucaucaccaucggcuccgucugcaugaccaucggcauggccaaccucauccuccagaucggcaacaucaucuccaucuggaucucccacuccauccagaucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112238 - RNA, 1410 nt, Artificial Sequence; identical to SEQ ID NO: 112228
  derived and/or modified sequence opt2 from neuraminidase__InfluenzaA__AEH59388

SEQ ID NO: 112239 - RNA, 1410 nt, Artificial Sequence
  derived and/or modified sequence opt2 from neuraminidase__InfluenzaA__AEH59390
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggccucaacgagugguccggcuacuccggcuccuucguccagcaccccgagcucaccggccucgacugcauccgccccugcuucugggucgagcucauccgcggccuccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112240 - RNA, 1410 nt, Artificial Sequence; identical to SEQ ID NO: 112228
  derived and/or modified sequence opt2 from neuraminidase__InfluenzaA__AEH59392

SEQ ID NO: 112241 - RNA, 1410 nt, Artificial Sequence; identical to SEQ ID NO: 112228
  derived and/or modified sequence opt2 from neuraminidase__InfluenzaA__AEH59396

SEQ ID NO: 112242 - RNA, 1410 nt, Artificial Sequence
  derived and/or modified sequence opt2 from neuraminidase__InfluenzaA__AEH59398
augaaccccaaccagaagaucaucaccaucggcuccgucugcaugaccaucggcgucgccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacuacauccuccgcacccaggaguccgagugcgccugcgucaacggcuccugcuucaccaucaugaccgacggccccuccgacggccaggccuccuacaagaucuuccgcaucgagaagggcaaggucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112243 - RNA, 1410 nt, Artificial Sequence
  derived and/or modified sequence opt2 from neuraminidase__InfluenzaA__AEH59400
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcgccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112244 - RNA, 1410 nt, Artificial Sequence
  derived and/or modified sequence opt2 from neuraminidase__InfluenzaA__AEH59402
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcgccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112245 - RNA, 1410 nt, Artificial Sequence
  derived and/or modified sequence opt2 from neuraminidase__InfluenzaA__AEH59404
augaaccccaaccagaagaucaucaccaucggcuccgccugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccagcccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112246 - RNA, 1410 nt, Artificial Sequence
  derived and/or modified sequence opt2 from neuraminidase__InfluenzaA__AEH59406
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaccuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuucaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucgacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112247 - RNA, 1410 nt, Artificial Sequence; identical to SEQ ID NO: 111769
  derived and/or modified sequence opt2 from neuraminidase__InfluenzaA__AEH59408

SEQ ID NO: 112248 - RNA, 1410 nt, Artificial Sequence
  derived and/or modified sequence opt2 from neuraminidase__InfluenzaA__AEH59412
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccauccgcuccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112249 - RNA, 1410 nt, Artificial Sequence; identical to SEQ ID NO: 112221
  derived and/or modified sequence opt2 from neuraminidase__InfluenzaA__AEH59416

SEQ ID NO: 112250 - RNA, 1410 nt, Artificial Sequence; identical to SEQ ID NO: 108250
  derived and/or modified sequence opt2 from neuraminidase__InfluenzaA__AEH59584

SEQ ID NO: 112251 - RNA, 1410 nt, Artificial Sequence; identical to SEQ ID NO: 108250
  derived and/or modified sequence opt2 from neuraminidase__InfluenzaA__AEH59586

SEQ ID NO: 112252 - RNA, 1410 nt, Artificial Sequence; identical to SEQ ID NO: 108250
  derived and/or modified sequence opt2 from neuraminidase__InfluenzaA__AEH59588

SEQ ID NO: 112253 - RNA, 1410 nt, Artificial Sequence; identical to SEQ ID NO: 108250
  derived and/or modified sequence opt2 from neuraminidase__InfluenzaA__AEH59592

SEQ ID NO: 112254 - RNA, 1410 nt, Artificial Sequence; identical to SEQ ID NO: 108250
  derived and/or modified sequence opt2 from neuraminidase__InfluenzaA__AEH59594

SEQ ID NO: 112255 - RNA, 1410 nt, Artificial Sequence; identical to SEQ ID NO: 108250
  derived and/or modified sequence opt2 from neuraminidase__InfluenzaA__AEH59596

SEQ ID NO: 112256 - RNA, 1410 nt, Artificial Sequence; identical to SEQ ID NO: 108250
  derived and/or modified sequence opt2 from neuraminidase__InfluenzaA__AEH59598

SEQ ID NO: 112257 - RNA, 1410 nt, Artificial Sequence; identical to SEQ ID NO: 108250
  derived and/or modified sequence opt2 from neuraminidase__InfluenzaA__AEH59600

SEQ ID NO: 112258 - RNA, 1410 nt, Artificial Sequence
  derived and/or modified sequence opt2 from neuraminidase__InfluenzaA__AEH59602
augaaccccaaccagaagaucaucaccaucggcuccgucugcaugaccaucggcauggccaaccucauccuccagaucggcaacaucaucuccaucuggaucucccacuccauccagcucggcucccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112259 - RNA, 1410 nt, Artificial Sequence; identical to SEQ ID NO: 108250
  derived and/or modified sequence opt2 from neuraminidase__InfluenzaA__AEH59606

SEQ ID NO: 112260 - RNA, 1410 nt, Artificial Sequence; identical to SEQ ID NO: 108250
  derived and/or modified sequence opt2 from neuraminidase__InfluenzaA__AEH59616

SEQ ID NO: 112261 - RNA, 1410 nt, Artificial Sequence; identical to SEQ ID NO: 108250
  derived and/or modified sequence opt2 from neuraminidase__InfluenzaA__AEH59626

SEQ ID NO: 112262 - RNA, 1413 nt, Artificial Sequence; identical to SEQ ID NO: 108973
  derived and/or modified sequence opt2 from neuraminidase__InfluenzaA__AEH77262

SEQ ID NO: 112263 - RNA, 1410 nt, Artificial Sequence
  derived and/or modified sequence opt2 from neuraminidase__InfluenzaA__AEH77273
augaaccccaaccagaagaucaucaccaucggcuccgucugcaugaccaucggcauggccaaccucauccuccagaucggcaacaucaccuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112264 - RNA, 1410 nt, Artificial Sequence
  derived and/or modified sequence opt2 from neuraminidase__InfluenzaA__AEH77282
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucgucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 112265 - RNA, 1410 nt, Artificial Sequence; identical to SEQ ID NO: 108250
  derived and/or modified sequence opt2 from neuraminidase__InfluenzaA__AEI29218

SEQ ID NO: 112266 - RNA, 1410 nt, Artificial Sequence; identical to SEQ ID NO: 109617
  derived and/or modified sequence opt2 from neuraminidase__InfluenzaA__AEI29228

SEQ ID NO: 112267 - RNA, 1410 nt, Artificial Sequence; identical to SEQ ID NO: 105649
  derived and/or modified sequence opt2 from neuraminidase__InfluenzaA__AEI54350

SEQ ID NO: 112268 - RNA, 1410 nt, Artificial Sequence; identical to SEQ ID NO: 105662
  derived and/or modified sequence opt2 from neuraminidase__InfluenzaA__AEI54361

SEQ ID NO: 112269 - RNA, 1410 nt, Artificial Sequence; identical to SEQ ID NO: 106226
  derived and/or modified sequence opt2 from neuraminidase__InfluenzaA__AEI54372

SEQ ID NO: 112270 - RNA, 1410 nt, Artificial Sequence; identical to SEQ ID NO: 106103
  derived and/or modified sequence opt2 from neuraminidase__InfluenzaA__AEI54383

SEQ ID NO: 112271 - RNA, 1410 nt, Artificial Sequence; identical to SEQ ID NO: 106226
  derived and/or modified sequence opt2 from neuraminidase__InfluenzaA__AEI54394

SEQ ID NO: 112272 - RNA, 1410 nt, Artificial Sequence; identical to SEQ ID NO: 107396
  derived and/or modified sequence opt2 from neuraminidase__InfluenzaA__AEI54416

SEQ ID NO: 112273 - RNA, 1410 nt, Artificial Sequence; identical to SEQ ID NO: 112216
  derived and/or modified sequence opt2 from neuraminidase__InfluenzaA__AEI54427

SEQ ID NO: 112274 - RNA, 1410 nt, Artificial Sequence; identical to SEQ ID NO: 111030
  derived and/or modified sequence opt2 from neuraminidase__InfluenzaA__AEI54438

SEQ ID NO: 112275 - RNA, 1410 nt, Artificial Sequence; identical to SEQ ID NO: 111030
  derived and/or modified sequence opt2 from neuraminidase__InfluenzaA__AEI54449

SEQ ID NO: 112276 - RNA, 1410 nt, Artificial Sequence; identical to SEQ ID NO: 111030
  derived and/or modified sequence opt2 from neuraminidase__InfluenzaA__AEI54460

SEQ ID NO: 112277 - RNA, 1410 nt, Artificial Sequence
  derived and/or modified sequence opt2 from neuraminidase__InfluenzaA__AEI54471
augaaccccaaccagaagaucaucaccaucggcuccgucucccucaccaucuccaccaucugcuucuucaugcagaucgccguccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112278 - RNA, 1410 nt, Artificial Sequence; identical to SEQ ID NO: 110922
  derived and/or modified sequence opt2 from neuraminidase__InfluenzaA__AEI54482

SEQ ID NO: 112279 - RNA, 1410 nt, Artificial Sequence
  derived and/or modified sequence opt2 from neuraminidase__InfluenzaA__AEI54493
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucauguccaucuga

SEQ ID NO: 112280 - RNA, 1410 nt, Artificial Sequence; identical to SEQ ID NO: 111030
  derived and/or modified sequence opt2 from neuraminidase__InfluenzaA__AEI54504

SEQ ID NO: 112281 - RNA, 1410 nt, Artificial Sequence; identical to SEQ ID NO: 110550
  derived and/or modified sequence opt2 from neuraminidase__InfluenzaA__AEI59982

SEQ ID NO: 112282 - RNA, 1413 nt, Artificial Sequence; identical to SEQ ID NO: 111448
  derived and/or modified sequence opt2 from neuraminidase__InfluenzaA__AEI59993

SEQ ID NO: 112283 - RNA, 1413 nt, Artificial Sequence; identical to SEQ ID NO: 111444
  derived and/or modified sequence opt2 from neuraminidase__InfluenzaA__AEI60004

SEQ ID NO: 112284 - RNA, 1410 nt, Artificial Sequence
  derived and/or modified sequence opt2 from neuraminidase__InfluenzaA__AEI60015
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggcaacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112285 - RNA, 1410 nt, Artificial Sequence; identical to SEQ ID NO: 109996
  derived and/or modified sequence opt2 from neuraminidase__InfluenzaA__AEI60026

SEQ ID NO: 112286 - RNA, 1410 nt, Artificial Sequence
  derived and/or modified sequence opt2 from neuraminidase__InfluenzaA__AEI60037
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgccgcaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112287 - RNA, 1410 nt, Artificial Sequence
  derived and/or modified sequence opt2 from neuraminidase__InfluenzaA__AEI60048
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgcccccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112288 - RNA, 1410 nt, Artificial Sequence
  derived and/or modified sequence opt2 from neuraminidase__InfluenzaA__AEI60089
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112289 - RNA, 1410 nt, Artificial Sequence; identical to SEQ ID NO: 112221
  derived and/or modified sequence opt2 from neuraminidase__InfluenzaA__AEI60099

SEQ ID NO: 112290 - RNA, 1410 nt, Artificial Sequence
  derived and/or modified sequence opt2 from neuraminidase__InfluenzaA__AEI60111
augaaccccaaccagaagaucaucaccaucggcuccaucucccucaccaucgccaccaucugcuuccucaugcagaucgccauccucgucaccaccgucacccuccacuucaagcaguacaagugcaacuccccccccaacaaccgcgucaugcucugcgagcccaccaucaucgagcgcaacaucaccgagaucgucuaccucaccaacaccaccaucgagaaggagaucugccccaagcucgccgaguaccgcaacugguccaagccccagugcaacaucaagggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcaucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacguccgcgacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccaggucaaccgccaggucaucgucgagcgcggcaaccgcuccggcuacuccggcaucuucuccgucgagggcaaguccugcaucaaccgcugcuucuacgucgagcucauccgcggccgcaaggaggagaccaaggucugguggaccuccaacuccaucgucgucuucugcggcaccuccggcaccuacggcaccggcuccuggcccgacggcgccgacaucaacaucaugcccaucuga

SEQ ID NO: 112291 - RNA, 1410 nt, Artificial Sequence; identical to SEQ ID NO: 108250
  derived and/or modified sequence opt2 from neuraminidase__InfluenzaA__AEI73669

SEQ ID NO: 112292 - RNA, 1410 nt, Artificial Sequence
  derived and/or modified sequence opt2 from neuraminidase__InfluenzaA__AEI86727
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacuccaaguucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112293 - RNA, 1410 nt, Artificial Sequence
  derived and/or modified sequence opt2 from neuraminidase__InfluenzaA__AEI86737
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaagaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaaggucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112294 - RNA, 1410 nt, Artificial Sequence
  derived and/or modified sequence opt2 from neuraminidase__InfluenzaA__AEI86757
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucaucucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112295 - RNA, 1410 nt, Artificial Sequence
  derived and/or modified sequence opt2 from neuraminidase__InfluenzaA__AEI86767
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccacaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112296 - RNA, 1410 nt, Artificial Sequence; identical to SEQ ID NO: 112295
  derived and/or modified sequence opt2 from neuraminidase__InfluenzaA__AEI86777

SEQ ID NO: 112297 - RNA, 1410 nt, Artificial Sequence
  derived and/or modified sequence opt2 from neuraminidase__InfluenzaA__AEI86787
augaaccccaaccagaagaucaucaccaucggcuccgucugcaugaccaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112298 - RNA, 1410 nt, Artificial Sequence
  derived and/or modified sequence opt2 from neuraminidase__InfluenzaA__AEI86797
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112299 - RNA, 1410 nt, Artificial Sequence
  derived and/or modified sequence opt2 from neuraminidase__InfluenzaA__AEI86807
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccaagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaucaucgacaaguga

SEQ ID NO: 112300 - RNA, 1410 nt, Artificial Sequence; identical to SEQ ID NO: 112295
  derived and/or modified sequence opt2 from neuraminidase__InfluenzaA__AEI86817

SEQ ID NO: 112301 - RNA, 1410 nt, Artificial Sequence
  derived and/or modified sequence opt2 from neuraminidase__InfluenzaA__AEI86827
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccacaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112302 - RNA, 1410 nt, Artificial Sequence; identical to SEQ ID NO: 112298
  derived and/or modified sequence opt2 from neuraminidase__InfluenzaA__AEI86837

SEQ ID NO: 112303 - RNA, 1410 nt, Artificial Sequence; identical to SEQ ID NO: 111769
  derived and/or modified sequence opt2 from neuraminidase__InfluenzaA__AEI86847

SEQ ID NO: 112304 - RNA, 1410 nt, Artificial Sequence
  derived and/or modified sequence opt2 from neuraminidase__InfluenzaA__AEI86867
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaaccucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacuccaaguucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112305 - RNA, 1410 nt, Artificial Sequence; identical to SEQ ID NO: 112298
  derived and/or modified sequence opt2 from neuraminidase__InfluenzaA__AEI86887

SEQ ID NO: 112306 - RNA, 1410 nt, Artificial Sequence; identical to SEQ ID NO: 112298
  derived and/or modified sequence opt2 from neuraminidase__InfluenzaA__AEI86897

SEQ ID NO: 112307 - RNA, 1410 nt, Artificial Sequence
  derived and/or modified sequence opt2 from neuraminidase__InfluenzaA__AEI86907
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacauccacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112308 - RNA, 1410 nt, Artificial Sequence
  derived and/or modified sequence opt2 from neuraminidase__InfluenzaA__AEI86917
augaaccccaaccagaagaucaucaccaucggcuccaucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112309 - RNA, 1410 nt, Artificial Sequence; identical to SEQ ID NO: 112221
  derived and/or modified sequence opt2 from neuraminidase__InfluenzaA__AEI86927

SEQ ID NO: 112310 - RNA, 1410 nt, Artificial Sequence; identical to SEQ ID NO: 112295
  derived and/or modified sequence opt2 from neuraminidase__InfluenzaA__AEI86937

SEQ ID NO: 112311 - RNA, 1410 nt, Artificial Sequence
  derived and/or modified sequence opt2 from neuraminidase__InfluenzaA__AEI86947
augaaccccaaccagaagaucaucaccaucggcuccgucugcaugaccaucggcauggccaaccucauccuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112312 - RNA, 1410 nt, Artificial Sequence
  derived and/or modified sequence opt2 from neuraminidase__InfluenzaA__AEI86967
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgccuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112313 - RNA, 1410 nt, Artificial Sequence
  derived and/or modified sequence opt2 from neuraminidase__InfluenzaA__AEI86977
augaaccccaaccagaagaucaucaccaucggcuccgucugcaugaccaucggcauggccaaccucauccuccagaucggcaacaucaucuccaucuggaucucccacuccauccagcucggcaaccagaaccagaucggcaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcaccugcgucaacggcuccugcuucaccgucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112314 - RNA, 1410 nt, Artificial Sequence
  derived and/or modified sequence opt2 from neuraminidase__InfluenzaA__AEI86997
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 112315 - RNA, 1410 nt, Artificial Sequence
  derived and/or modified sequence opt2 from neuraminidase__InfluenzaA__AEI87007
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccucccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112316 - RNA, 1410 nt, Artificial Sequence
  derived and/or modified sequence opt2 from neuraminidase__InfluenzaA__AEI87017
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacggcgacaccggcggcugguccuggcccgacggcgccgagcuccccuucaccaucgacaaguga

SEQ ID NO: 112317 - RNA, 1410 nt, Artificial Sequence; identical to SEQ ID NO: 112221
  derived and/or modified sequence opt2 from neuraminidase__InfluenzaA__AEI87027

SEQ ID NO: 112318 - RNA, 1410 nt, Artificial Sequence; identical to SEQ ID NO: 112314
  derived and/or modified sequence opt2 from neuraminidase__InfluenzaA__AEI87037

SEQ ID NO: 112319 - RNA, 1410 nt, Artificial Sequence; identical to SEQ ID NO: 112298
  derived and/or modified sequence opt2 from neuraminidase__InfluenzaA__AEI87047

SEQ ID NO: 112320 - RNA, 1410 nt, Artificial Sequence
  derived and/or modified sequence opt2 from neuraminidase__InfluenzaA__AEI87057
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112321 - RNA, 1410 nt, Artificial Sequence; identical to SEQ ID NO: 111769
  derived and/or modified sequence opt2 from neuraminidase__InfluenzaA__AEI87067

SEQ ID NO: 112322 - RNA, 1410 nt, Artificial Sequence
  derived and/or modified sequence opt2 from neuraminidase__InfluenzaA__AEI87077
augaaccccaaccagaagaucaucaccaucggcuccaucugcaugaccaucggcauggccaaccucauccuccagaucggcaacaucaucuccaucuggaucucccacuccauccaguucggcaaccagaaccagaucggcaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112323 - RNA, 1410 nt, Artificial Sequence
  derived and/or modified sequence opt2 from neuraminidase__InfluenzaA__AEI87087
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccaucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcuccgucaacuccgacaccgucggcugguccuggcccgacggcgccgagcuccccuucaccaucgacaaguga

SEQ ID NO: 112324 - RNA, 1410 nt, Artificial Sequence; identical to SEQ ID NO: 112295
  derived and/or modified sequence opt2 from neuraminidase__InfluenzaA__AEI87097

SEQ ID NO: 112325 - RNA, 1410 nt, Artificial Sequence; identical to SEQ ID NO: 112295
  derived and/or modified sequence opt2 from neuraminidase__InfluenzaA__AEI87107

SEQ ID NO: 112326 - RNA, 1413 nt, Artificial Sequence
  derived and/or modified sequence opt2 from neuraminidase__InfluenzaA__AEI91968
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcaucaagcccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112327 - RNA, 1410 nt, Artificial Sequence; identical to SEQ ID NO: 108250
  derived and/or modified sequence opt2 from neuraminidase__InfluenzaA__AEI91983

SEQ ID NO: 112328 - RNA, 1410 nt, Artificial Sequence; identical to SEQ ID NO: 110736
  derived and/or modified sequence opt2 from neuraminidase__InfluenzaA__AEI91984

SEQ ID NO: 112329 - RNA, 1410 nt, Artificial Sequence
  derived and/or modified sequence opt2 from neuraminidase__InfluenzaA__AEI92004
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccuacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112330 - RNA, 1413 nt, Artificial Sequence
  derived and/or modified sequence opt2 from neuraminidase__InfluenzaA__AEI92023
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagaagaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcaccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112331 - RNA, 1410 nt, Artificial Sequence
  derived and/or modified sequence opt2 from neuraminidase__InfluenzaA__AEJ10403
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccgccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112332 - RNA, 1410 nt, Artificial Sequence; identical to SEQ ID NO: 112298
  derived and/or modified sequence opt2 from neuraminidase__InfluenzaA__AEJ10413

SEQ ID NO: 112333 - RNA, 1410 nt, Artificial Sequence; identical to SEQ ID NO: 112320
  derived and/or modified sequence opt2 from neuraminidase__InfluenzaA__AEJ10423

SEQ ID NO: 112334 - RNA, 1410 nt, Artificial Sequence
  derived and/or modified sequence opt2 from neuraminidase__InfluenzaA__AEJ10433
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 112335 - RNA, 1410 nt, Artificial Sequence; identical to SEQ ID NO: 111769
  derived and/or modified sequence opt2 from neuraminidase__InfluenzaA__AEJ10443

SEQ ID NO: 112336 - RNA, 1410 nt, Artificial Sequence; identical to SEQ ID NO: 111769
  derived and/or modified sequence opt2 from neuraminidase__InfluenzaA__AEJ10453

SEQ ID NO: 112337 - RNA, 1410 nt, Artificial Sequence; identical to SEQ ID NO: 112221
  derived and/or modified sequence opt2 from neuraminidase__InfluenzaA__AEJ10463

SEQ ID NO: 112338 - RNA, 1410 nt, Artificial Sequence
  derived and/or modified sequence opt2 from neuraminidase__InfluenzaA__AEJ10473
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaagaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112339 - RNA, 1410 nt, Artificial Sequence; identical to SEQ ID NO: 111769
  derived and/or modified sequence opt2 from neuraminidase__InfluenzaA__AEJ10503

SEQ ID NO: 112340 - RNA, 1410 nt, Artificial Sequence; identical to SEQ ID NO: 108250
  derived and/or modified sequence opt2 from neuraminidase__InfluenzaA__AEJ10523

SEQ ID NO: 112341 - RNA, 1410 nt, Artificial Sequence; identical to SEQ ID NO: 108250
  derived and/or modified sequence opt2 from neuraminidase__InfluenzaA__AEJ10533

SEQ ID NO: 112342 - RNA, 1410 nt, Artificial Sequence; identical to SEQ ID NO: 108250
  derived and/or modified sequence opt2 from neuraminidase__InfluenzaA__AEJ10543

SEQ ID NO: 112343 - RNA, 1410 nt, Artificial Sequence; identical to SEQ ID NO: 108250
  derived and/or modified sequence opt2 from neuraminidase__InfluenzaA__AEJ10553

SEQ ID NO: 112344 - RNA, 1410 nt, Artificial Sequence; identical to SEQ ID NO: 110525
  derived and/or modified sequence opt2 from neuraminidase__InfluenzaA__AEJ10563

SEQ ID NO: 112345 - RNA, 1410 nt, Artificial Sequence; identical to SEQ ID NO: 110525
  derived and/or modified sequence opt2 from neuraminidase__InfluenzaA__AEJ10573

SEQ ID NO: 112346 - RNA, 1410 nt, Artificial Sequence; identical to SEQ ID NO: 110525
  derived and/or modified sequence opt2 from neuraminidase__InfluenzaA__AEJ10583

SEQ ID NO: 112347 - RNA, 1410 nt, Artificial Sequence
  derived and/or modified sequence opt2 from neuraminidase__InfluenzaA__AEJ36305
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaccuccucccgcaacggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112348 - RNA, 1410 nt, Artificial Sequence; identical to SEQ ID NO: 108250
  derived and/or modified sequence opt2 from neuraminidase__InfluenzaA__AEJ37856

SEQ ID NO: 112349 - RNA, 1410 nt, Artificial Sequence; identical to SEQ ID NO: 108250
  derived and/or modified sequence opt2 from neuraminidase__InfluenzaA__AEJ37866

SEQ ID NO: 112350 - RNA, 1410 nt, Artificial Sequence; identical to SEQ ID NO: 108250
  derived and/or modified sequence opt2 from neuraminidase__InfluenzaA__AEJ37876

SEQ ID NO: 112351 - RNA, 1410 nt, Artificial Sequence; identical to SEQ ID NO: 112298
  derived and/or modified sequence opt2 from neuraminidase__InfluenzaA__AEJ37886

SEQ ID NO: 112352 - RNA, 1410 nt, Artificial Sequence
  derived and/or modified sequence opt2 from neuraminidase__InfluenzaA__AEJ37896
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggccgcaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112353 - RNA, 1410 nt, Artificial Sequence; identical to SEQ ID NO: 112298
  derived and/or modified sequence opt2 from neuraminidase__InfluenzaA__AEJ37906

SEQ ID NO: 112354 - RNA, 1410 nt, Artificial Sequence; identical to SEQ ID NO: 112298
  derived and/or modified sequence opt2 from neuraminidase__InfluenzaA__AEJ37916

SEQ ID NO: 112355 - RNA, 1410 nt, Artificial Sequence; identical to SEQ ID NO: 112298
  derived and/or modified sequence opt2 from neuraminidase__InfluenzaA__AEJ37926

SEQ ID NO: 112356 - RNA, 1410 nt, Artificial Sequence; identical to SEQ ID NO: 110152
  derived and/or modified sequence opt2 from neuraminidase__InfluenzaA__AEJ37936

SEQ ID NO: 112357 - RNA, 1410 nt, Artificial Sequence; identical to SEQ ID NO: 108250
  derived and/or modified sequence opt2 from neuraminidase__InfluenzaA__AEJ37946

SEQ ID NO: 112358 - RNA, 1410 nt, Artificial Sequence; identical to SEQ ID NO: 112298
  derived and/or modified sequence opt2 from neuraminidase__InfluenzaA__AEJ37956

SEQ ID NO: 112359 - RNA, 1410 nt, Artificial Sequence; identical to SEQ ID NO: 112298
  derived and/or modified sequence opt2 from neuraminidase__InfluenzaA__AEJ37966

SEQ ID NO: 112360 - RNA, 1410 nt, Artificial Sequence; identical to SEQ ID NO: 108250
  derived and/or modified sequence opt2 from neuraminidase__InfluenzaA__AEJ37976

SEQ ID NO: 112361 - RNA, 1410 nt, Artificial Sequence; identical to SEQ ID NO: 112298
  derived and/or modified sequence opt2 from neuraminidase__InfluenzaA__AEJ37986

SEQ ID NO: 112362 - RNA, 1410 nt, Artificial Sequence; identical to SEQ ID NO: 110922
  derived and/or modified sequence opt2 from neuraminidase__InfluenzaA__AEK21372

SEQ ID NO: 112363 - RNA, 1413 nt, Artificial Sequence; identical to SEQ ID NO: 111716
  derived and/or modified sequence opt2 from neuraminidase__InfluenzaA__AEK21383

SEQ ID NO: 112364 - RNA, 1410 nt, Artificial Sequence; identical to SEQ ID NO: 110152
  derived and/or modified sequence opt2 from neuraminidase__InfluenzaA__AEK21399

SEQ ID NO: 112365 - RNA, 1410 nt, Artificial Sequence; identical to SEQ ID NO: 108250
  derived and/or modified sequence opt2 from neuraminidase__InfluenzaA__AEK21409

SEQ ID NO: 112366 - RNA, 1410 nt, Artificial Sequence; identical to SEQ ID NO: 112221
  derived and/or modified sequence opt2 from neuraminidase__InfluenzaA__AEK21419

SEQ ID NO: 112367 - RNA, 1410 nt, Artificial Sequence; identical to SEQ ID NO: 112298
  derived and/or modified sequence opt2 from neuraminidase__InfluenzaA__AEK21429

SEQ ID NO: 112368 - RNA, 1410 nt, Artificial Sequence
  derived and/or modified sequence opt2 from neuraminidase__InfluenzaA__AEK21439
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaagaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112369 - RNA, 1410 nt, Artificial Sequence; identical to SEQ ID NO: 112298
  derived and/or modified sequence opt2 from neuraminidase__InfluenzaA__AEK21449

SEQ ID NO: 112370 - RNA, 1410 nt, Artificial Sequence; identical to SEQ ID NO: 110152
  derived and/or modified sequence opt2 from neuraminidase__InfluenzaA__AEK21459

SEQ ID NO: 112371 - RNA, 1410 nt, Artificial Sequence; identical to SEQ ID NO: 112298
  derived and/or modified sequence opt2 from neuraminidase__InfluenzaA__AEK21469

SEQ ID NO: 112372 - RNA, 1410 nt, Artificial Sequence; identical to SEQ ID NO: 112298
  derived and/or modified sequence opt2 from neuraminidase__InfluenzaA__AEK21479

SEQ ID NO: 112373 - RNA, 1410 nt, Artificial Sequence; identical to SEQ ID NO: 108250
  derived and/or modified sequence opt2 from neuraminidase__InfluenzaA__AEK21489

SEQ ID NO: 112374 - RNA, 1410 nt, Artificial Sequence; identical to SEQ ID NO: 111966
  derived and/or modified sequence opt2 from neuraminidase__InfluenzaA__AEK28776

SEQ ID NO: 112375 - RNA, 1410 nt, Artificial Sequence
  derived and/or modified sequence opt2 from neuraminidase__InfluenzaA__AEK28787
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggccgcuccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112376 - RNA, 1410 nt, Artificial Sequence
  derived and/or modified sequence opt2 from neuraminidase__InfluenzaA__AEK28798
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugcuccgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112377 - RNA, 1410 nt, Artificial Sequence
  derived and/or modified sequence opt2 from neuraminidase__InfluenzaA__AEK28809
augaaccccaaccagaagaucaucaccaucggcuccgucucccucaccaucuccaccaucugcuucuucaugcagaucgccauccucaucaccaccgucaccguccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaagguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112378 - RNA, 1410 nt, Artificial Sequence
  derived and/or modified sequence opt2 from neuraminidase__InfluenzaA__AEK28819
augaaccccaaccagaagaucaucaccaucggcuccgucucccucaccaucuccaccaucugcuucuucaugcagaucgccauccucaucaccaccgucacccuccacuucaagcaguacgaguucaacuacccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgagcgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112379 - RNA, 1410 nt, Artificial Sequence
  derived and/or modified sequence opt2 from neuraminidase__InfluenzaA__AEK28830
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaaccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112380 - RNA, 1410 nt, Artificial Sequence
  derived and/or modified sequence opt2 from neuraminidase__InfluenzaA__AEK28841
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccaccgucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112381 - RNA, 1410 nt, Artificial Sequence
  derived and/or modified sequence opt2 from neuraminidase__InfluenzaA__AEK28852
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaaccgcguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112382 - RNA, 1410 nt, Artificial Sequence; identical to SEQ ID NO: 109996
  derived and/or modified sequence opt2 from neuraminidase__InfluenzaA__AEK28863

SEQ ID NO: 112383 - RNA, 1410 nt, Artificial Sequence
  derived and/or modified sequence opt2 from neuraminidase__InfluenzaA__AEK28874
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaagguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112384 - RNA, 1410 nt, Artificial Sequence
  derived and/or modified sequence opt2 from neuraminidase__InfluenzaA__AEK28885
augaaccccaaccagaagaucaucaccaucggcuccgucucccucaccaucuccaccaucugcuucuucaugcagaucgccauccucaucaccaccgucacccuccacuucaagcaguacgaguucaaccucccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112385 - RNA, 1410 nt, Artificial Sequence; identical to SEQ ID NO: 110121
  derived and/or modified sequence opt2 from neuraminidase__InfluenzaA__AEK28896

SEQ ID NO: 112386 - RNA, 1410 nt, Artificial Sequence
  derived and/or modified sequence opt2 from neuraminidase__InfluenzaA__AEK28907
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugcccccgccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112387 - RNA, 1410 nt, Artificial Sequence; identical to SEQ ID NO: 108111
  derived and/or modified sequence opt2 from neuraminidase__InfluenzaA__AEK28918

SEQ ID NO: 112388 - RNA, 1410 nt, Artificial Sequence; identical to SEQ ID NO: 109417
  derived and/or modified sequence opt2 from neuraminidase__InfluenzaA__AEK28929

SEQ ID NO: 112389 - RNA, 1410 nt, Artificial Sequence
  derived and/or modified sequence opt2 from neuraminidase__InfluenzaA__AEK28951
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgaggcccucuggaccuccaacuccaucgucgucuucugcggcaccuccggcaccuacggcaccggcuccuggcccgacggcgccgaccucaaccucaugcccaucuga

SEQ ID NO: 112390 - RNA, 1410 nt, Artificial Sequence
  derived and/or modified sequence opt2 from neuraminidase__InfluenzaA__AEK28962
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccccaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112391 - RNA, 1410 nt, Artificial Sequence
  derived and/or modified sequence opt2 from neuraminidase__InfluenzaA__AEK28973
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaacuucaugcccaucuga

SEQ ID NO: 112392 - RNA, 1410 nt, Artificial Sequence
  derived and/or modified sequence opt2 from neuraminidase__InfluenzaA__AEK28984
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccguccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112393 - RNA, 1410 nt, Artificial Sequence; identical to SEQ ID NO: 112392
  derived and/or modified sequence opt2 from neuraminidase__InfluenzaA__AEK28995

SEQ ID NO: 112394 - RNA, 1410 nt, Artificial Sequence; identical to SEQ ID NO: 111030
  derived and/or modified sequence opt2 from neuraminidase__InfluenzaA__AEK29006

SEQ ID NO: 112395 - RNA, 1410 nt, Artificial Sequence
  derived and/or modified sequence opt2 from neuraminidase__InfluenzaA__AEK29028
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112396 - RNA, 1410 nt, Artificial Sequence
  derived and/or modified sequence opt2 from neuraminidase__InfluenzaA__AEK29050
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112397 - RNA, 1410 nt, Artificial Sequence
  derived and/or modified sequence opt2 from neuraminidase__InfluenzaA__AEK29061
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112398 - RNA, 1410 nt, Artificial Sequence
  derived and/or modified sequence opt2 from neuraminidase__InfluenzaA__AEK29083
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112399 - RNA, 1410 nt, Artificial Sequence; identical to SEQ ID NO: 110922
  derived and/or modified sequence opt2 from neuraminidase__InfluenzaA__AEK29094

SEQ ID NO: 112400 - RNA, 1410 nt, Artificial Sequence; identical to SEQ ID NO: 111030
  derived and/or modified sequence opt2 from neuraminidase__InfluenzaA__AEK29127

SEQ ID NO: 112401 - RNA, 1410 nt, Artificial Sequence; identical to SEQ ID NO: 111030
  derived and/or modified sequence opt2 from neuraminidase__InfluenzaA__AEK29138

SEQ ID NO: 112402 - RNA, 1410 nt, Artificial Sequence
  derived and/or modified sequence opt2 from neuraminidase__InfluenzaA__AEK29182
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccaggucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112403 - RNA, 1410 nt, Artificial Sequence
  derived and/or modified sequence opt2 from neuraminidase__InfluenzaA__AEK29204
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccaacaccaagguccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112404 - RNA, 1410 nt, Artificial Sequence
  derived and/or modified sequence opt2 from neuraminidase__InfluenzaA__AEK29215
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112405 - RNA, 1410 nt, Artificial Sequence; identical to SEQ ID NO: 112403
  derived and/or modified sequence opt2 from neuraminidase__InfluenzaA__AEK29237

SEQ ID NO: 112406 - RNA, 1410 nt, Artificial Sequence; identical to SEQ ID NO: 111030
  derived and/or modified sequence opt2 from neuraminidase__InfluenzaA__AEK29248

SEQ ID NO: 112407 - RNA, 1410 nt, Artificial Sequence; identical to SEQ ID NO: 111030
  derived and/or modified sequence opt2 from neuraminidase__InfluenzaA__AEK29259

SEQ ID NO: 112408 - RNA, 1410 nt, Artificial Sequence; identical to SEQ ID NO: 111030
  derived and/or modified sequence opt2 from neuraminidase__InfluenzaA__AEK29270

SEQ ID NO: 112409 - RNA, 1413 nt, Artificial Sequence
  derived and/or modified sequence opt2 from neuraminidase__InfluenzaA__AEK59839
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggccucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112410 - RNA, 1410 nt, Artificial Sequence
  derived and/or modified sequence opt2 from neuraminidase__InfluenzaA__AEK98375
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaccaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112411 - RNA, 1410 nt, Artificial Sequence; identical to SEQ ID NO: 108111
  derived and/or modified sequence opt2 from neuraminidase__InfluenzaA__AEK98377

SEQ ID NO: 112412 - RNA, 1410 nt, Artificial Sequence; identical to SEQ ID NO: 107553
  derived and/or modified sequence opt2 from neuraminidase__InfluenzaA__AEK98379

SEQ ID NO: 112413 - RNA, 1410 nt, Artificial Sequence
  derived and/or modified sequence opt2 from neuraminidase__InfluenzaA__AEK98381
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcgaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112414 - RNA, 1410 nt, Artificial Sequence; identical to SEQ ID NO: 107553
  derived and/or modified sequence opt2 from neuraminidase__InfluenzaA__AEK98383

SEQ ID NO: 112415 - RNA, 1410 nt, Artificial Sequence; identical to SEQ ID NO: 108111
  derived and/or modified sequence opt2 from neuraminidase__InfluenzaA__AEK98385

SEQ ID NO: 112416 - RNA, 1410 nt, Artificial Sequence
  derived and/or modified sequence opt2 from neuraminidase__InfluenzaA__AEK98387
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucaucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112417 - RNA, 1410 nt, Artificial Sequence; identical to SEQ ID NO: 108111
  derived and/or modified sequence opt2 from neuraminidase__InfluenzaA__AEK98389

SEQ ID NO: 112418 - RNA, 1410 nt, Artificial Sequence
  derived and/or modified sequence opt2 from neuraminidase__InfluenzaA__AEK98393
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112419 - RNA, 1410 nt, Artificial Sequence; identical to SEQ ID NO: 111030
  derived and/or modified sequence opt2 from neuraminidase__InfluenzaA__AEK98395

SEQ ID NO: 112420 - RNA, 1410 nt, Artificial Sequence
  derived and/or modified sequence opt2 from neuraminidase__InfluenzaA__AEK98397
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaacuucaugcccaucuga

SEQ ID NO: 112421 - RNA, 1410 nt, Artificial Sequence; identical to SEQ ID NO: 108111
  derived and/or modified sequence opt2 from neuraminidase__InfluenzaA__AEK98399

SEQ ID NO: 112422 - RNA, 1410 nt, Artificial Sequence; identical to SEQ ID NO: 108024
  derived and/or modified sequence opt2 from neuraminidase__InfluenzaA__AEK98403

SEQ ID NO: 112423 - RNA, 1410 nt, Artificial Sequence
  derived and/or modified sequence opt2 from neuraminidase__InfluenzaA__AEK98405
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112424 - RNA, 1410 nt, Artificial Sequence
  derived and/or modified sequence opt2 from neuraminidase__InfluenzaA__AEK98407
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcguccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112425 - RNA, 1410 nt, Artificial Sequence; identical to SEQ ID NO: 105839
  derived and/or modified sequence opt2 from neuraminidase__InfluenzaA__AEL11690

SEQ ID NO: 112426 - RNA, 1410 nt, Artificial Sequence; identical to SEQ ID NO: 110525
  derived and/or modified sequence opt2 from neuraminidase__InfluenzaA__AEL89300

SEQ ID NO: 112427 - RNA, 1410 nt, Artificial Sequence; identical to SEQ ID NO: 110525
  derived and/or modified sequence opt2 from neuraminidase__InfluenzaA__AEL89310

SEQ ID NO: 112428 - RNA, 1410 nt, Artificial Sequence; identical to SEQ ID NO: 110525
  derived and/or modified sequence opt2 from neuraminidase__InfluenzaA__AEL89320

SEQ ID NO: 112429 - RNA, 1410 nt, Artificial Sequence; identical to SEQ ID NO: 110525
  derived and/or modified sequence opt2 from neuraminidase__InfluenzaA__AEL89330

SEQ ID NO: 112430 - RNA, 1410 nt, Artificial Sequence; identical to SEQ ID NO: 110525
  derived and/or modified sequence opt2 from neuraminidase__InfluenzaA__AEL89340

SEQ ID NO: 112431 - RNA, 1410 nt, Artificial Sequence; identical to SEQ ID NO: 110525
  derived and/or modified sequence opt2 from neuraminidase__InfluenzaA__AEL89350

SEQ ID NO: 112432 - RNA, 1410 nt, Artificial Sequence; identical to SEQ ID NO: 110525
  derived and/or modified sequence opt2 from neuraminidase__InfluenzaA__AEL89360

SEQ ID NO: 112433 - RNA, 1410 nt, Artificial Sequence; identical to SEQ ID NO: 110525
  derived and/or modified sequence opt2 from neuraminidase__InfluenzaA__AEL89370

SEQ ID NO: 112434 - RNA, 1410 nt, Artificial Sequence; identical to SEQ ID NO: 110525
  derived and/or modified sequence opt2 from neuraminidase__InfluenzaA__AEL89394

SEQ ID NO: 112435 - RNA, 1410 nt, Artificial Sequence; identical to SEQ ID NO: 110525
  derived and/or modified sequence opt2 from neuraminidase__InfluenzaA__AEL89404

SEQ ID NO: 112436 - RNA, 1410 nt, Artificial Sequence; identical to SEQ ID NO: 110525
  derived and/or modified sequence opt2 from neuraminidase__InfluenzaA__AEL89414

SEQ ID NO: 112437 - RNA, 1410 nt, Artificial Sequence; identical to SEQ ID NO: 110525
  derived and/or modified sequence opt2 from neuraminidase__InfluenzaA__AEL89424

SEQ ID NO: 112438 - RNA, 1410 nt, Artificial Sequence; identical to SEQ ID NO: 110525
  derived and/or modified sequence opt2 from neuraminidase__InfluenzaA__AEL89434

SEQ ID NO: 112439 - RNA, 1410 nt, Artificial Sequence; identical to SEQ ID NO: 110525
  derived and/or modified sequence opt2 from neuraminidase__InfluenzaA__AEL89444

SEQ ID NO: 112440 - RNA, 1410 nt, Artificial Sequence; identical to SEQ ID NO: 110525
  derived and/or modified sequence opt2 from neuraminidase__InfluenzaA__AEL89454

SEQ ID NO: 112441 - RNA, 1410 nt, Artificial Sequence; identical to SEQ ID NO: 110525
  derived and/or modified sequence opt2 from neuraminidase__InfluenzaA__AEL89464

SEQ ID NO: 112442 - RNA, 1410 nt, Artificial Sequence; identical to SEQ ID NO: 110525
  derived and/or modified sequence opt2 from neuraminidase__InfluenzaA__AEL89474

SEQ ID NO: 112443 - RNA, 1410 nt, Artificial Sequence
  derived and/or modified sequence opt2 from neuraminidase__InfluenzaA__AEL89484
augaaccccaaccagaagaucaucaccaucggcuccgucugcaugaccaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112444 - RNA, 1410 nt, Artificial Sequence; identical to SEQ ID NO: 112314
  derived and/or modified sequence opt2 from neuraminidase__InfluenzaA__AEL89494

SEQ ID NO: 112445 - RNA, 1410 nt, Artificial Sequence; identical to SEQ ID NO: 112320
  derived and/or modified sequence opt2 from neuraminidase__InfluenzaA__AEL89514

SEQ ID NO: 112446 - RNA, 1410 nt, Artificial Sequence; identical to SEQ ID NO: 112298
  derived and/or modified sequence opt2 from neuraminidase__InfluenzaA__AEL89524

SEQ ID NO: 112447 - RNA, 1410 nt, Artificial Sequence
  derived and/or modified sequence opt2 from neuraminidase__InfluenzaA__AEL89534
augaaccccaaccagaagaucaucaccaucggcuccgucugcaugaccaucggcauggccaaccucauccuccagaucggcaacaucaucuccaucuggaucucccacuccauccagcucggcaaccagaaccagaucggcaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaagaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112448 - RNA, 1410 nt, Artificial Sequence; identical to SEQ ID NO: 112320
  derived and/or modified sequence opt2 from neuraminidase__InfluenzaA__AEL89544

SEQ ID NO: 112449 - RNA, 1410 nt, Artificial Sequence; identical to SEQ ID NO: 112320
  derived and/or modified sequence opt2 from neuraminidase__InfluenzaA__AEL89554

SEQ ID NO: 112450 - RNA, 1410 nt, Artificial Sequence
  derived and/or modified sequence opt2 from neuraminidase__InfluenzaA__AEL89564
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucgucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112451 - RNA, 1410 nt, Artificial Sequence; identical to SEQ ID NO: 112320
  derived and/or modified sequence opt2 from neuraminidase__InfluenzaA__AEL89574

SEQ ID NO: 112452 - RNA, 1410 nt, Artificial Sequence; identical to SEQ ID NO: 112320
  derived and/or modified sequence opt2 from neuraminidase__InfluenzaA__AEL89584

SEQ ID NO: 112453 - RNA, 1410 nt, Artificial Sequence; identical to SEQ ID NO: 109267
  derived and/or modified sequence opt2 from neuraminidase__InfluenzaA__AEL89604

SEQ ID NO: 112454 - RNA, 1410 nt, Artificial Sequence; identical to SEQ ID NO: 111769
  derived and/or modified sequence opt2 from neuraminidase__InfluenzaA__AEL89624

SEQ ID NO: 112455 - RNA, 1410 nt, Artificial Sequence
  derived and/or modified sequence opt2 from neuraminidase__InfluenzaA__AEL89634
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuacaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112456 - RNA, 1410 nt, Artificial Sequence; identical to SEQ ID NO: 110525
  derived and/or modified sequence opt2 from neuraminidase__InfluenzaA__AEL89644

SEQ ID NO: 112457 - RNA, 1410 nt, Artificial Sequence; identical to SEQ ID NO: 112221
  derived and/or modified sequence opt2 from neuraminidase__InfluenzaA__AEL89654

SEQ ID NO: 112458 - RNA, 1410 nt, Artificial Sequence; identical to SEQ ID NO: 111769
  derived and/or modified sequence opt2 from neuraminidase__InfluenzaA__AEL89664

SEQ ID NO: 112459 - RNA, 1410 nt, Artificial Sequence; identical to SEQ ID NO: 111769
  derived and/or modified sequence opt2 from neuraminidase__InfluenzaA__AEL89674

SEQ ID NO: 112460 - RNA, 1410 nt, Artificial Sequence; identical to SEQ ID NO: 111769
  derived and/or modified sequence opt2 from neuraminidase__InfluenzaA__AEL89694

SEQ ID NO: 112461 - RNA, 1410 nt, Artificial Sequence
  derived and/or modified sequence opt2 from neuraminidase__InfluenzaA__AEL89704
augaaccccaaccagaagaucaucaccaucggcuccgucugcaugaccaucggcauggccaaccucauccuccagaucggcaacaucauccucaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccaacgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccgucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112462 - RNA, 1410 nt, Artificial Sequence; identical to SEQ ID NO: 112461
  derived and/or modified sequence opt2 from neuraminidase__InfluenzaA__AEL89714

SEQ ID NO: 112463 - RNA, 1410 nt, Artificial Sequence; identical to SEQ ID NO: 111769
  derived and/or modified sequence opt2 from neuraminidase__InfluenzaA__AEL89744

SEQ ID NO: 112464 - RNA, 1410 nt, Artificial Sequence
  derived and/or modified sequence opt2 from neuraminidase__InfluenzaA__AEL89754
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaucaucgacaaguga

SEQ ID NO: 112465 - RNA, 1410 nt, Artificial Sequence; identical to SEQ ID NO: 110525
  derived and/or modified sequence opt2 from neuraminidase__InfluenzaA__AEL89774

SEQ ID NO: 112466 - RNA, 1410 nt, Artificial Sequence
  derived and/or modified sequence opt2 from neuraminidase__InfluenzaA__AEL89784
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucucccuccgcaacggcuucgagaugaucugggaccccaacggcuggaccggcaccgacaacaacuucuccgucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112467 - RNA, 1410 nt, Artificial Sequence
  derived and/or modified sequence opt2 from neuraminidase__InfluenzaA__AEL89794
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacgccgucggcugguccuggcccgacggcgccgagcuccccuucaccaucgacaaguga

SEQ ID NO: 112468 - RNA, 1410 nt, Artificial Sequence; identical to SEQ ID NO: 112221
  derived and/or modified sequence opt2 from neuraminidase__InfluenzaA__AEL89804

SEQ ID NO: 112469 - RNA, 1410 nt, Artificial Sequence
  derived and/or modified sequence opt2 from neuraminidase__InfluenzaA__AEL89815
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccgucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112470 - RNA, 1410 nt, Artificial Sequence
  derived and/or modified sequence opt2 from neuraminidase__InfluenzaA__AEL89825
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcgccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112471 - RNA, 1410 nt, Artificial Sequence
  derived and/or modified sequence opt2 from neuraminidase__InfluenzaA__AEL89835
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112472 - RNA, 1410 nt, Artificial Sequence
  derived and/or modified sequence opt2 from neuraminidase__InfluenzaA__AEL89845
augaaccccaaccagaagaucaucaccaucggcuccgucugcaugaccaucggcauggccaaccucauccuccagaucggcaacaucaucuccaucuggaucucccacuccauccagcucggcaacaagaaccagaucgagaccugcaaccaguccgucaucaccuacgagaacaacaccugggucaaccagaccuacgucaacaucuccaacaccaacuucgccaccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgaggcccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaagggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112473 - RNA, 1410 nt, Artificial Sequence; identical to SEQ ID NO: 112470
  derived and/or modified sequence opt2 from neuraminidase__InfluenzaA__AEL89855

SEQ ID NO: 112474 - RNA, 1410 nt, Artificial Sequence; identical to SEQ ID NO: 111769
  derived and/or modified sequence opt2 from neuraminidase__InfluenzaA__AEL93581

SEQ ID NO: 112475 - RNA, 1410 nt, Artificial Sequence
  derived and/or modified sequence opt2 from neuraminidase__InfluenzaA__AEL93591
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaaccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112476 - RNA, 1410 nt, Artificial Sequence; identical to SEQ ID NO: 112221
  derived and/or modified sequence opt2 from neuraminidase__InfluenzaA__AEL93601

SEQ ID NO: 112477 - RNA, 1410 nt, Artificial Sequence; identical to SEQ ID NO: 111769
  derived and/or modified sequence opt2 from neuraminidase__InfluenzaA__AEL93611

SEQ ID NO: 112478 - RNA, 1410 nt, Artificial Sequence; identical to SEQ ID NO: 111769
  derived and/or modified sequence opt2 from neuraminidase__InfluenzaA__AEL93621

SEQ ID NO: 112479 - RNA, 1410 nt, Artificial Sequence; identical to SEQ ID NO: 111769
  derived and/or modified sequence opt2 from neuraminidase__InfluenzaA__AEL93631

SEQ ID NO: 112480 - RNA, 1410 nt, Artificial Sequence
  derived and/or modified sequence opt2 from neuraminidase__InfluenzaA__AEL93641
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccacaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccagcccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112481 - RNA, 1410 nt, Artificial Sequence; identical to SEQ ID NO: 112320
  derived and/or modified sequence opt2 from neuraminidase__InfluenzaA__AEL94890

SEQ ID NO: 112482 - RNA, 1410 nt, Artificial Sequence
  derived and/or modified sequence opt2 from neuraminidase__InfluenzaA__AEL95429
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcuccccccaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112483 - RNA, 1410 nt, Artificial Sequence
  derived and/or modified sequence opt2 from neuraminidase__InfluenzaA__AEL97634
augaaccccaaccagaagaucaucaccaucggcuccgucugcaugaccaucggcauggccaaccucauccuccagaucggcaacaucaucuccaucugggucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcgucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112484 - RNA, 1410 nt, Artificial Sequence; identical to SEQ ID NO: 108250
  derived and/or modified sequence opt2 from neuraminidase__InfluenzaA__AEL99667

SEQ ID NO: 112485 - RNA, 1410 nt, Artificial Sequence; identical to SEQ ID NO: 108250
  derived and/or modified sequence opt2 from neuraminidase__InfluenzaA__AEL99677

SEQ ID NO: 112486 - RNA, 1410 nt, Artificial Sequence; identical to SEQ ID NO: 107288
  derived and/or modified sequence opt2 from neuraminidase__InfluenzaA__AEM53471

SEQ ID NO: 112487 - RNA, 1413 nt, Artificial Sequence; identical to SEQ ID NO: 107965
  derived and/or modified sequence opt2 from neuraminidase__InfluenzaA__AEM60040

SEQ ID NO: 112488 - RNA, 1413 nt, Artificial Sequence; identical to SEQ ID NO: 107555
  derived and/or modified sequence opt2 from neuraminidase__InfluenzaA__AEM60061

SEQ ID NO: 112489 - RNA, 1410 nt, Artificial Sequence
  derived and/or modified sequence opt2 from neuraminidase__InfluenzaA__AEM60072
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 112490 - RNA, 1410 nt, Artificial Sequence; identical to SEQ ID NO: 108250
  derived and/or modified sequence opt2 from neuraminidase__InfluenzaA__AEM62774

SEQ ID NO: 112491 - RNA, 1410 nt, Artificial Sequence; identical to SEQ ID NO: 108250
  derived and/or modified sequence opt2 from neuraminidase__InfluenzaA__AEM62783

SEQ ID NO: 112492 - RNA, 1410 nt, Artificial Sequence
  derived and/or modified sequence opt2 from neuraminidase__InfluenzaA__AEM62792
augaaccccaaccagaagaucaucaccaucggcuccgucugcaugaccaucggcauggccaaccucauccuccagaucggcaacaucaucuccaucuggaucucccacuccauccagcucggcucccagaaccagaucgagaccugcaaccaguccgucaucaccuacgagaacaacaccugggucaaccagaccuacgucaacaucuccaacaccaacuucgccgccggccaguccgucaucuccguccgccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112493 - RNA, 1410 nt, Artificial Sequence; identical to SEQ ID NO: 108250
  derived and/or modified sequence opt2 from neuraminidase__InfluenzaA__AEM62801

SEQ ID NO: 112494 - RNA, 1410 nt, Artificial Sequence
  derived and/or modified sequence opt2 from neuraminidase__InfluenzaA__AEM62810
augaaccccaaccagaagaucaucaccaucggcuccgucugcaugaccaucggcaugggcaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112495 - RNA, 1410 nt, Artificial Sequence
  derived and/or modified sequence opt2 from neuraminidase__InfluenzaA__AEM62819
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacgacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112496 - RNA, 1410 nt, Artificial Sequence; identical to SEQ ID NO: 108250
  derived and/or modified sequence opt2 from neuraminidase__InfluenzaA__AEM62828

SEQ ID NO: 112497 - RNA, 1410 nt, Artificial Sequence; identical to SEQ ID NO: 108833
  derived and/or modified sequence opt2 from neuraminidase__InfluenzaA__AEM62837

SEQ ID NO: 112498 - RNA, 1410 nt, Artificial Sequence; identical to SEQ ID NO: 108250
  derived and/or modified sequence opt2 from neuraminidase__InfluenzaA__AEM62846

SEQ ID NO: 112499 - RNA, 1410 nt, Artificial Sequence
  derived and/or modified sequence opt2 from neuraminidase__InfluenzaA__AEM62855
augaaccccaaccagaagaucaucaccaucggcuccgucugcaucaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112500 - RNA, 1410 nt, Artificial Sequence
  derived and/or modified sequence opt2 from neuraminidase__InfluenzaA__AEM62864
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuucggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112501 - RNA, 1410 nt, Artificial Sequence
  derived and/or modified sequence opt2 from neuraminidase__InfluenzaA__AEM62872
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuucaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112502 - RNA, 1410 nt, Artificial Sequence; identical to SEQ ID NO: 108250
  derived and/or modified sequence opt2 from neuraminidase__InfluenzaA__AEM92310

SEQ ID NO: 112503 - RNA, 1410 nt, Artificial Sequence; identical to SEQ ID NO: 109712
  derived and/or modified sequence opt2 from neuraminidase__InfluenzaA__AEM92320

SEQ ID NO: 112504 - RNA, 1410 nt, Artificial Sequence
  derived and/or modified sequence opt2 from neuraminidase__InfluenzaA__AEM92340
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggacccgcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112505 - RNA, 1410 nt, Artificial Sequence; identical to SEQ ID NO: 109712
  derived and/or modified sequence opt2 from neuraminidase__InfluenzaA__AEM92350

SEQ ID NO: 112506 - RNA, 1410 nt, Artificial Sequence
  derived and/or modified sequence opt2 from neuraminidase__InfluenzaA__AEM92360
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccgagcaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112507 - RNA, 1410 nt, Artificial Sequence; identical to SEQ ID NO: 112504
  derived and/or modified sequence opt2 from neuraminidase__InfluenzaA__AEM92370

SEQ ID NO: 112508 - RNA, 1410 nt, Artificial Sequence; identical to SEQ ID NO: 112504
  derived and/or modified sequence opt2 from neuraminidase__InfluenzaA__AEM92380

SEQ ID NO: 112509 - RNA, 1410 nt, Artificial Sequence
  derived and/or modified sequence opt2 from neuraminidase__InfluenzaA__AEM92399
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaccaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccguccucuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112510 - RNA, 1410 nt, Artificial Sequence; identical to SEQ ID NO: 112509
  derived and/or modified sequence opt2 from neuraminidase__InfluenzaA__AEM92409

SEQ ID NO: 112511 - RNA, 1410 nt, Artificial Sequence; identical to SEQ ID NO: 108674
  derived and/or modified sequence opt2 from neuraminidase__InfluenzaA__AEM92419

SEQ ID NO: 112512 - RNA, 1410 nt, Artificial Sequence
  derived and/or modified sequence opt2 from neuraminidase__InfluenzaA__AEM92430
augaaccccaaccagaagaucaugaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112513 - RNA, 1410 nt, Artificial Sequence
  derived and/or modified sequence opt2 from neuraminidase__InfluenzaA__AEM92440
augaaccccaaccagaagaucaucaccaucggcuccgucugcaucaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaucgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112514 - RNA, 1410 nt, Artificial Sequence; identical to SEQ ID NO: 112470
  derived and/or modified sequence opt2 from neuraminidase__InfluenzaA__AEM92450

SEQ ID NO: 112515 - RNA, 1410 nt, Artificial Sequence; identical to SEQ ID NO: 112470
  derived and/or modified sequence opt2 from neuraminidase__InfluenzaA__AEM92460

SEQ ID NO: 112516 - RNA, 1410 nt, Artificial Sequence; identical to SEQ ID NO: 112221
  derived and/or modified sequence opt2 from neuraminidase__InfluenzaA__AEM92470

SEQ ID NO: 112517 - RNA, 1410 nt, Artificial Sequence; identical to SEQ ID NO: 112221
  derived and/or modified sequence opt2 from neuraminidase__InfluenzaA__AEM92480

SEQ ID NO: 112518 - RNA, 1410 nt, Artificial Sequence
  derived and/or modified sequence opt2 from neuraminidase__InfluenzaA__AEM92490
augaaccccaaccagaagaucaucaccaucggcuccgucugcaugaucaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112519 - RNA, 1410 nt, Artificial Sequence
  derived and/or modified sequence opt2 from neuraminidase__InfluenzaA__AEM92500
augaaccccaaccagaagaucaucaccaucggcuccgucugcaugaucaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112520 - RNA, 1410 nt, Artificial Sequence
  derived and/or modified sequence opt2 from neuraminidase__InfluenzaA__AEM92520
augaaccccaaccagaagaucaucaccaucggcuccgucugcaugaccaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112521 - RNA, 1410 nt, Artificial Sequence; identical to SEQ ID NO: 112221
  derived and/or modified sequence opt2 from neuraminidase__InfluenzaA__AEM92550

SEQ ID NO: 112522 - RNA, 1410 nt, Artificial Sequence
  derived and/or modified sequence opt2 from neuraminidase__InfluenzaA__AEM92570
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcaacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112523 - RNA, 1410 nt, Artificial Sequence
  derived and/or modified sequence opt2 from neuraminidase__InfluenzaA__AEM92580
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112524 - RNA, 1410 nt, Artificial Sequence; identical to SEQ ID NO: 112221
  derived and/or modified sequence opt2 from neuraminidase__InfluenzaA__AEM92590

SEQ ID NO: 112525 - RNA, 1410 nt, Artificial Sequence; identical to SEQ ID NO: 112221
  derived and/or modified sequence opt2 from neuraminidase__InfluenzaA__AEM92600

SEQ ID NO: 112526 - RNA, 1410 nt, Artificial Sequence
  derived and/or modified sequence opt2 from neuraminidase__InfluenzaA__AEM92610
augaaccccaaccagaagaucaucaccaucggcuccgucugcaugaccaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucuccugguccuggcccgacggcgccgagcuccccuucaccaucgacaaguga

SEQ ID NO: 112527 - RNA, 1410 nt, Artificial Sequence
  derived and/or modified sequence opt2 from neuraminidase__InfluenzaA__AEM92620
augaaccccaaccagaagaucaucaccaucggcuccgucugcaugaucaucggcauggccaaccucaugcuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucgacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112528 - RNA, 1410 nt, Artificial Sequence
  derived and/or modified sequence opt2 from neuraminidase__InfluenzaA__AEM92650
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaccaaguucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112529 - RNA, 1410 nt, Artificial Sequence; identical to SEQ ID NO: 110922
  derived and/or modified sequence opt2 from neuraminidase__InfluenzaA__AEM98410

SEQ ID NO: 112530 - RNA, 1410 nt, Artificial Sequence; identical to SEQ ID NO: 110922
  derived and/or modified sequence opt2 from neuraminidase__InfluenzaA__AEM98421

SEQ ID NO: 112531 - RNA, 1410 nt, Artificial Sequence; identical to SEQ ID NO: 110922
  derived and/or modified sequence opt2 from neuraminidase__InfluenzaA__AEM98432

SEQ ID NO: 112532 - RNA, 1410 nt, Artificial Sequence; identical to SEQ ID NO: 112298
  derived and/or modified sequence opt2 from neuraminidase__InfluenzaA__AEN55401

SEQ ID NO: 112533 - RNA, 1410 nt, Artificial Sequence; identical to SEQ ID NO: 110525
  derived and/or modified sequence opt2 from neuraminidase__InfluenzaA__AEN55411

SEQ ID NO: 112534 - RNA, 1410 nt, Artificial Sequence
  derived and/or modified sequence opt2 from neuraminidase__InfluenzaA__AEN55421
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgcccgccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgucugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112535 - RNA, 1410 nt, Artificial Sequence
  derived and/or modified sequence opt2 from neuraminidase__InfluenzaA__AEN55466
augaaccccaaccagaagaucaucaccaucggcuccgucugcaucaccaucggcauggccaaccucauccuccagaucggcaacaccaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112536 - RNA, 1410 nt, Artificial Sequence
  derived and/or modified sequence opt2 from neuraminidase__InfluenzaA__AEN55476
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucuccugguccuggcccgacggcgccgagcuccccuucaccaucgacaaguga

SEQ ID NO: 112537 - RNA, 1410 nt, Artificial Sequence; identical to SEQ ID NO: 111769
  derived and/or modified sequence opt2 from neuraminidase__InfluenzaA__AEN55486

SEQ ID NO: 112538 - RNA, 1410 nt, Artificial Sequence; identical to SEQ ID NO: 111769
  derived and/or modified sequence opt2 from neuraminidase__InfluenzaA__AEN55506

SEQ ID NO: 112539 - RNA, 1410 nt, Artificial Sequence
  derived and/or modified sequence opt2 from neuraminidase__InfluenzaA__AEN55516
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcucccgcggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112540 - RNA, 1410 nt, Artificial Sequence; identical to SEQ ID NO: 111769
  derived and/or modified sequence opt2 from neuraminidase__InfluenzaA__AEN55526

SEQ ID NO: 112541 - RNA, 1410 nt, Artificial Sequence; identical to SEQ ID NO: 112298
  derived and/or modified sequence opt2 from neuraminidase__InfluenzaA__AEN69429

SEQ ID NO: 112542 - RNA, 1410 nt, Artificial Sequence; identical to SEQ ID NO: 112295
  derived and/or modified sequence opt2 from neuraminidase__InfluenzaA__AEN69438

SEQ ID NO: 112543 - RNA, 1410 nt, Artificial Sequence; identical to SEQ ID NO: 110525
  derived and/or modified sequence opt2 from neuraminidase__InfluenzaA__AEN69484

SEQ ID NO: 112544 - RNA, 1410 nt, Artificial Sequence; identical to SEQ ID NO: 108197
  derived and/or modified sequence opt2 from neuraminidase__InfluenzaA__AEO01627

SEQ ID NO: 112545 - RNA, 1410 nt, Artificial Sequence; identical to SEQ ID NO: 108197
  derived and/or modified sequence opt2 from neuraminidase__InfluenzaA__AEO01638

SEQ ID NO: 112546 - RNA, 1410 nt, Artificial Sequence
  derived and/or modified sequence opt2 from neuraminidase__InfluenzaA__AEO01644
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaccgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112547 - RNA, 1410 nt, Artificial Sequence
  derived and/or modified sequence opt2 from neuraminidase__InfluenzaA__AEO01654
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgagaucaaccucaugcccaucuga

SEQ ID NO: 112548 - RNA, 1413 nt, Artificial Sequence; identical to SEQ ID NO: 108144
  derived and/or modified sequence opt2 from neuraminidase__InfluenzaA__AEO01665

SEQ ID NO: 112549 - RNA, 1413 nt, Artificial Sequence
  derived and/or modified sequence opt2 from neuraminidase__InfluenzaA__AEO01676
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuucuuccgcggcgacaacuccgacaccgccaacugguccuggcccgacggcgccgagaugaccuucaccaucgacaaguga

SEQ ID NO: 112550 - RNA, 1410 nt, Artificial Sequence; identical to SEQ ID NO: 108197
  derived and/or modified sequence opt2 from neuraminidase__InfluenzaA__AEO01693

SEQ ID NO: 112551 - RNA, 1413 nt, Artificial Sequence; identical to SEQ ID NO: 108144
  derived and/or modified sequence opt2 from neuraminidase__InfluenzaA__AEO01711

SEQ ID NO: 112552 - RNA, 1410 nt, Artificial Sequence; identical to SEQ ID NO: 112320
  derived and/or modified sequence opt2 from neuraminidase__InfluenzaA__AEO37533

SEQ ID NO: 112553 - RNA, 1410 nt, Artificial Sequence
  derived and/or modified sequence opt2 from neuraminidase__InfluenzaA__AEO37543
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagcccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccgucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112554 - RNA, 1410 nt, Artificial Sequence; identical to SEQ ID NO: 111769
  derived and/or modified sequence opt2 from neuraminidase__InfluenzaA__AEO72179

SEQ ID NO: 112555 - RNA, 1350 nt, Artificial Sequence
  derived and/or modified sequence opt2 from neuraminidase__InfluenzaA__AEO88957
augaaccccaaccagaagaucaucaccaucggcuccaucugcauggucaucggcaucgucucccucaugcuccagaucggcaacaugaucuccaucugggucucccacuccacccagaccggcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112556 - RNA, 1350 nt, Artificial Sequence
  derived and/or modified sequence opt2 from neuraminidase__InfluenzaA__AEO88965
augaaccccaaccagaagaucaucaccaucggcuccaucugcauggucaucgagaucgucucccucaugcuccagaucggcaacaugaucuccaucugggucucccacuccauccagaccaagaaccagcgccaggccgagcccaucuccaacaccaaguuccucaccgagaaggccgucgccuccgucacccucgccggcaacuccucccucugccccaucuccggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucaacugcauccgccccugcuucugggucgagcucguccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 112557 - RNA, 1350 nt, Artificial Sequence
  derived and/or modified sequence opt2 from neuraminidase__InfluenzaA__AEO88973
augaaccccaaccagaagaucaucaccaucggcuccaucugcauggucaucggcaucgucucccucaugcuccagaucggcaacaugaucucccucugggucucccacuccauccagaccggcaaccagcaccaggucgagcccaucuccaacaccaacuuccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaugaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggccgcgucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaagucccccaacucccgcuccggcuucgagaugaucugggaccccaacggcuggaucgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112558 - RNA, 1350 nt, Artificial Sequence
  derived and/or modified sequence opt2 from neuraminidase__InfluenzaA__AEO88982
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcaucuucggcgacaacccccgcccccacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacgacgccgagcuccccuucaccaucgacaaguga

SEQ ID NO: 112559 - RNA, 1350 nt, Artificial Sequence
  derived and/or modified sequence opt2 from neuraminidase__InfluenzaA__AEO88990
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacgacgccgagcuccccuucaccaucgacaaguga

SEQ ID NO: 112560 - RNA, 1350 nt, Artificial Sequence
  derived and/or modified sequence opt2 from neuraminidase__InfluenzaA__AEO88998
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacgagcaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112561 - RNA, 1350 nt, Artificial Sequence
  derived and/or modified sequence opt2 from neuraminidase__InfluenzaA__AEO89006
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucaucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112562 - RNA, 1350 nt, Artificial Sequence
  derived and/or modified sequence opt2 from neuraminidase__InfluenzaA__AEO89023
augaaccccaaccagaagaucaucaccaucggcuccaucugcauggucaucggcaucgucucccucaugcuccagaucggcaacauggucucccucugggucucccacuccauccagaccggcaaccagcaccaggucgagcccaucuccaacaccaacuuccucaccgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaugaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaagucccccuccucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112563 - RNA, 1350 nt, Artificial Sequence
  derived and/or modified sequence opt2 from neuraminidase__InfluenzaA__AEO89032
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112564 - RNA, 1350 nt, Artificial Sequence
  derived and/or modified sequence opt2 from neuraminidase__InfluenzaA__AEO89041
augaaccccaaccagaagaucaucaccaucggcuccaucugcauggucaucggccucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccgucaagcaggacaucgucgccaucaccgacugguccggcuacuccggcuccuucguccagcaccccgagcucaccggccucgacugcauccgccccugcuucuggaucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112565 - RNA, 1350 nt, Artificial Sequence
  derived and/or modified sequence opt2 from neuraminidase__InfluenzaA__AEO89050
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccaugggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112566 - RNA, 1350 nt, Artificial Sequence
  derived and/or modified sequence opt2 from neuraminidase__InfluenzaA__AEO89058
augaaccccaaccagaagaucaucaccaucggcuccaucugcauggucaucggcaucgucucccucaugcuccagaucggcaacaugaucuccaucugggucucccacuccauccagaccggcaaccagcgccaggccgagcccaucuccaacaccaaguuccucaccgagaaggccgucgccuccgucacccucgccggcaacuccucccucugccccaucuccggcugggccgucuacuccaaggacaacuccauccgcaucggcucccgcggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgacuaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaaguccaccaacucccgcuccggcuucgagaugaucugggaccccaacggcuggaccggcaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112567 - RNA, 1350 nt, Artificial Sequence
  derived and/or modified sequence opt2 from neuraminidase__InfluenzaA__AEO89075
augaaccccaaccagaagaucaucaccaucggcuccaucugcauggucaucggcaucgucucccucaugcuccagaucggcaacaugaucuccaucugggucucccacuccauccagcgcggcaaccucaaccaggucgagcccaucuccaacaccaacuuccucaccgagaaggccgucgccuccgucacccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgagguccccucccccuacaacucccgcuucgaguccgucgccugguccgccuccgccugccacgacggcaccuccuggcucaccaucggcaucuccggccccgacaacggcgccgucgccgucgucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112568 - RNA, 1350 nt, Artificial Sequence
  derived and/or modified sequence opt2 from neuraminidase__InfluenzaA__AEO89084
augaaccccaaccagaagaucaucaccaucggcuccaucugcauggucaucggcaucgucucccucaugcuccagaucggcaacaugaucuccaucuggaucuccuacuccauccagaccggcaaccagcaccaggccgagcccacccgcaacgccaccuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagauggagaagggcaaggucgucaaguccgucgagcucaucgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112569 - RNA, 1350 nt, Artificial Sequence
  derived and/or modified sequence opt2 from neuraminidase__InfluenzaA__AEO89093
augaaccccaaccagaagaucaucaccaucggcuccaucugcauggucaucggcaucgucucccucaugcuccagaucggcaacaugaucucccucugggucucccacuccauccagaccggcaaccagcaccaggucgagcccaucuccaacaccaacuuccucgucgagaaggccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaugaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggccgcgucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaagucccccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112570 - RNA, 1350 nt, Artificial Sequence
  derived and/or modified sequence opt2 from neuraminidase__InfluenzaA__AEO89102
augaaccccaaccagaagaucaucaccaucggcuccaucugcauggucaucggcaucgucucccucaugcuccagaucggcaacaugaucuccaucuggaucucccacuccauccagaccggcaaccagaaccaggucgagcccaucuccaacaccaacuuccucaccgagaaggccgucgccuccgucauccucgccggcaacuccucccucugccccauccgcggcugggccauccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacuccggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucaucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccacaacggcgccuacggcgucaagggcuucuccuucaaguacggcaacggcgucuggaucggccgcaccaagucccccaacucccgcuccggcuucgagaugaucugggaccccaacggcugguccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucaccaucgacaaguga

SEQ ID NO: 112571 - RNA, 1350 nt, Artificial Sequence
  derived and/or modified sequence opt2 from neuraminidase__InfluenzaA__AEO89111
augaaccccaaccagaagaucaucaccaucggcuccaucugcauggucaucggcaucgucucccucaugcuccagaucggcaacaucaucuccaucugggucucccacuccauccagaccggcaaccagcaccaggacgagcccauccgcaacgccaacguccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcgaccccgucucccccaacggcgccuacggcaucaagggcuucuccuucaaguacggcaacggcgucuggaucggccgcaccaaguccaccaacucccgcuccggcuucgagaugaucugggaccccaacggcuggaccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112572 - RNA, 1350 nt, Artificial Sequence
  derived and/or modified sequence opt2 from neuraminidase__InfluenzaA__AEO89120
augaaccccaaccagaagaucaucaccaucggcuccaucugcauggucaucggcaucgucucccucaugcuccagaucggcaacaugaucuccaucugggucucccacuccauccagaccggcaaccagcaccaggccgagcccauccgcaacgccuccuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcugggccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggagggcaccaucuggaccuccggcuccuccaucuccuucugcggcgucaacuccgacaccgucuccugguccuggcccgacggcgccgagcuccccuucaccaucgacaaguga

SEQ ID NO: 112573 - RNA, 1350 nt, Artificial Sequence
  derived and/or modified sequence opt2 from neuraminidase__InfluenzaA__AEO89129
augaaccccaaccagaagaucaucaccaucggcuccaucugcauggucaucggcaucgucucccucaugcuccagaucggcaacaucaucuccaucugggucucccacuccacccagaccggcaaccagcaccaggacgagcccauccgcaacgccaacuuccucaccgagaacgccgucgccuccgucacccucgccggcaacuccucccucugccccguccgcggcugggccguccacuccaaggacaacuccauccgcgucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcgaccccgucucccccaacggcgccuacggcaucaagggcuucuccuucaaguacggcaacggcgucuggaucggccgcaccaaguccaccaacucccgcuccggcuucgagaugaucugggaccccaacggcuggaccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112574 - RNA, 1350 nt, Artificial Sequence
  derived and/or modified sequence opt2 from neuraminidase__InfluenzaA__AEO89138
augaaccccaaccagaagaucaucaccaucggcuccaucugcauggucaccggcaucgucucccucaugcuccagaucggcaacaucaucuccaugugggucucccacuccauccagacccgcaaccagcaccaggccgagcccauccgcaacaccaacuuccucaccgagaacgccgucgccuccgucacccucaccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacaacgacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccgucuggaccuccggcuccuccaucuccuucugcggcgucaacuccgacaccgucuccugguccuggcccgacggcgccgagcuccccuucaccaucgacaaguga

SEQ ID NO: 112575 - RNA, 1350 nt, Artificial Sequence
  derived and/or modified sequence opt2 from neuraminidase__InfluenzaA__AEO89156
augaaccccaaccagaagaucaucaccaucggcuccaucugcauggucaccggcaucgucucccucaugcuccagaucggcaacaucaccuccaugugggucucccacuccauccagacccgcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112576 - RNA, 1350 nt, Artificial Sequence
  derived and/or modified sequence opt2 from neuraminidase__InfluenzaA__AEO89174
augaaccccaaccagaagaucaucaccaucggcuccaucugcauggucaccggcaucgucucccucaugcuccagaucggcaacaucaucuccaugugggucucccacuccauccagacccgcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112577 - RNA, 1350 nt, Artificial Sequence
  derived and/or modified sequence opt2 from neuraminidase__InfluenzaA__AEO89183
augaaccccaaccagaagaucgucaccaucggcuccaucugcauggucaucggcaucgucucccucaugcuccagaucggcaacaugaucuccaucugggucucccacuccauccagaccggcaaccagcaccagaccgagcccauccgcaacaccaacuuccucaccgagaacaccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccaucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaagggcuccugcggccccgucucccccaacggcgccuacggcgucaagggcuucuccuucaaguacggcaacggcgucuggaucggccgcaccaaguccacccacucccgcuccggcuucgagaugaucugggaccccaacggcuggaccggcaccgacuccgaguucuccaugaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112578 - RNA, 1350 nt, Artificial Sequence
  derived and/or modified sequence opt2 from neuraminidase__InfluenzaA__AEO89205
augaaccccacccagaagaucaucaccaucggcuccaucugcauggucaucggcaucgucucccucaugcuccagaucggcaacaugaucuccaucugggucucccacuccauccagaccggcaaccagcaccaggccgagcccauccgcaacgccuccuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcugggccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggagggcaccaucuggaccuccggcuccuccaucuccuucugcggcgucaacuccgacaccgucuccugguccuggcccgacggcgccgagcuccccuucaccaucgacaaguga

SEQ ID NO: 112579 - RNA, 1350 nt, Artificial Sequence
  derived and/or modified sequence opt2 from neuraminidase__InfluenzaA__AEO89215
augaaccccaaccagaagaucaucaccaucggcuccaucugcauggccaucggcaucgucucccucaugcuccagaucggcaacaugaucuccaucugggucucccacuccauccagaccggcaaccagcaccaggccgagcccauccgcaacgccuccuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcugggccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggagggcaccaucuggaccuccggcuccuccaucuccuucugcggcgucaacuccgacaccgucuccugguccuggcccgacggcgccgagcuccccuucaccaucgacaaguga

SEQ ID NO: 112580 - RNA, 1350 nt, Artificial Sequence
  derived and/or modified sequence opt2 from neuraminidase__InfluenzaA__AEO89226
augaaccccacccagaagaucaucaccaucggcuccaucugcauggccaucggcaucgucucccucaugcuccagaucggcaacaugaucuccaucugggucucccacuccauccagaccggcaaccagcaccaggccgagcccauccgcaacgccuccuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaucuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcugggccgagaccgacuccaacuucuccgucaagcaggacaucgucgccaucaccgacugguccggcuacuccggcuccuucguccagcaccccgagcucaccggccucgacugcauccgccccugcuucugggucgagcucauccgcggccgccccaaggagggcaccaucuggaccuccggcuccuccaucuccuucugcggcgucaacuccgacaccgucuccugguccuggcccgacggcgccgagcuccccuucaccaucgacaaguga

SEQ ID NO: 112581 - RNA, 1350 nt, Artificial Sequence
  derived and/or modified sequence opt2 from neuraminidase__InfluenzaA__AEO89237
augaaccccaaccagaagaucaucaccaucggcuccaucugcauggucaucggcaucgucucccucaugcuccagaucggcaacaucaucuccaugugggucucccacuccauccagacccgcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112582 - RNA, 1350 nt, Artificial Sequence
  derived and/or modified sequence opt2 from neuraminidase__InfluenzaA__AEO89248
augaaccccaaccagaagaucaucaccaucggcuccaucugcauggucaucggcaucgucucccucaugcuccagaucggcaacaucaucuccaucugggucucccacuccuuccagacccgcguccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagaugaagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccaugaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112583 - RNA, 1350 nt, Artificial Sequence
  derived and/or modified sequence opt2 from neuraminidase__InfluenzaA__AEO89270
augaaccccaaccagaagaucaucaccaucggcuccaucugcauggucaccggcaucgucucccucaugcuccagaucggcaacaucaccuccaugugggucucccacuccauccagacccgcaaccagcaccaggccgagcccauccgcaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgucgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccgacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucggcugguccuggcccgacggcgccgagcuccccuucaccaucgacaaguga

SEQ ID NO: 112584 - RNA, 1350 nt, Artificial Sequence
  derived and/or modified sequence opt2 from neuraminidase__InfluenzaA__AEO89281
augaaccccaaccagaagaucaucaccaucggcuccaucugcauggucgucggcaucgucucccucaugcuccagaucggcaacaucgucuccaucugggucucccacuccauccagaccggccaccagcagcaggccgagcccaucaagaacaccaacuuccucaccaagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacacccuccgcacccaggaguccgagugcgccugcgucaacggcuccugcuucaccgucaugaccgacggccccuccaacggccaggccuccuacaagaucuucaagauggagaagggcaaggucgucaaguccgccgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccaugaagcaggacaucgucgccaucaccgagugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112585 - RNA, 1350 nt, Artificial Sequence
  derived and/or modified sequence opt2 from neuraminidase__InfluenzaA__AEO89291
augaaccccaaccagaagaucaucaccaucggcuccaucugcauggucgucggcaucgucucccucaugcuccagaucggcaacaucgucuccaucugggucucccacuccauccagaccggccaccagcagcaggccgagcccaucaagaacaccaacuuccucaccgagaacgccgucgccuccgucacccucgccggcaacuccucccucugccccauccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucgucaaguccgccgagcucaacgcccccaacuaccacuacgaggagugcuccugcuaccccgacgccggcgagaucaucugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucucccccaacggcgccuacggcaucaagggcuucuccuucaaguacggcaacggcgucuggaucggccgcaccaaguccaccaacucccgcuccggcuucgagaugaucugggaccccaacggcuggaccggcaccgacuccaacuucuccaugaagcaggacaucgucgccaucaccgagugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaacuccgacaccgucuccugguccuggcccgacggcgccgagcuccccuucaccaucgacaaguga

SEQ ID NO: 112586 - RNA, 1350 nt, Artificial Sequence
  derived and/or modified sequence opt2 from neuraminidase__InfluenzaA__AEO89302
augaaccccaaccagaagaucaucaccaucggcuccaucugcauggucaucggcaucgucucccucaugcuccagaucggcaacaucaucuccaucugggucucccacuccauccagaccggcaaccagcaccaggacgagcccauccgcaacgccaacuuccucaccgagaacgccgucgccuccgucacccucgccggcaacuccucccucugccccguccgcggcugggccguccacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuucaagauggagaagggcaaggucguccgcuccgucgagcucaacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcgaccccgucucccccaacggcgccuacggcaucaagggcuucuccuucaaguacggcaacggcgucuggaucggccgcaccaaguccaccaacucccgcuccggcuucgagaugaucugggaccccaacggcuggaccgagaccgacuccgacuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucuccuccgacaccgucuccugguccuggcccgacggcgccgagcuccccuucaccaucgacaaguga

SEQ ID NO: 112587 - RNA, 1410 nt, Artificial Sequence; identical to SEQ ID NO: 107569
  derived and/or modified sequence opt2 from neuraminidase__InfluenzaA__AEO99218

SEQ ID NO: 112588 - RNA, 1410 nt, Artificial Sequence
  derived and/or modified sequence opt2 from neuraminidase__InfluenzaA__AEQ49739
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgaggucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112589 - RNA, 1410 nt, Artificial Sequence; identical to SEQ ID NO: 111769
  derived and/or modified sequence opt2 from neuraminidase__InfluenzaA__AEQ49740

SEQ ID NO: 112590 - RNA, 1410 nt, Artificial Sequence
  derived and/or modified sequence opt2 from neuraminidase__InfluenzaA__AEQ49741
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112591 - RNA, 1410 nt, Artificial Sequence
  derived and/or modified sequence opt2 from neuraminidase__InfluenzaA__AEQ49742
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccauccacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112592 - RNA, 1410 nt, Artificial Sequence
  derived and/or modified sequence opt2 from neuraminidase__InfluenzaA__AEQ49743
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaacuga

SEQ ID NO: 112593 - RNA, 1410 nt, Artificial Sequence
  derived and/or modified sequence opt2 from neuraminidase__InfluenzaA__AEQ49744
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccucgucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacaucuuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccaggaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcagaacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112594 - RNA, 1410 nt, Artificial Sequence; identical to SEQ ID NO: 112590
  derived and/or modified sequence opt2 from neuraminidase__InfluenzaA__AEQ49745

SEQ ID NO: 112595 - RNA, 1410 nt, Artificial Sequence; identical to SEQ ID NO: 112590
  derived and/or modified sequence opt2 from neuraminidase__InfluenzaA__AEQ49746

SEQ ID NO: 112596 - RNA, 1410 nt, Artificial Sequence; identical to SEQ ID NO: 112590
  derived and/or modified sequence opt2 from neuraminidase__InfluenzaA__AEQ49747

SEQ ID NO: 112597 - RNA, 1410 nt, Artificial Sequence; identical to SEQ ID NO: 111769
  derived and/or modified sequence opt2 from neuraminidase__InfluenzaA__AEQ49748

SEQ ID NO: 112598 - RNA, 1410 nt, Artificial Sequence; identical to SEQ ID NO: 112590
  derived and/or modified sequence opt2 from neuraminidase__InfluenzaA__AEQ49749

SEQ ID NO: 112599 - RNA, 1410 nt, Artificial Sequence
  derived and/or modified sequence opt2 from neuraminidase__InfluenzaA__AEQ49750
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaaccacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaagaacaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112600 - RNA, 1410 nt, Artificial Sequence
  derived and/or modified sequence opt2 from neuraminidase__InfluenzaA__AEQ49751
augaaccccaaccagaagaucaucaccaucggcuccgucugcaugaccaucggcauggccaaccucauccuccagaucggcaacaucaucuccaucuggaucucccacuccuuccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaaccacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112601 - RNA, 1410 nt, Artificial Sequence
  derived and/or modified sequence opt2 from neuraminidase__InfluenzaA__AEQ49752
augaaccccaaccagaagaucaucaccaucggcuccgucugcaugaccaucggcauggccaaccucauccuccagaucggcaacaucaucuccaucuggaucucccacuccauccagcucggcaaccagucccagaucggcaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112602 - RNA, 1410 nt, Artificial Sequence
  derived and/or modified sequence opt2 from neuraminidase__InfluenzaA__AEQ49753
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucgacugguccuggcccgacggcgccgagcuccccuucaccaucgacaaguga

SEQ ID NO: 112603 - RNA, 1410 nt, Artificial Sequence
  derived and/or modified sequence opt2 from neuraminidase__InfluenzaA__AEQ49754
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccaacaccgucggcugguccuggcccgacggcgccgagcuccccuucaccaucgacaaguga

SEQ ID NO: 112604 - RNA, 1410 nt, Artificial Sequence; identical to SEQ ID NO: 112590
  derived and/or modified sequence opt2 from neuraminidase__InfluenzaA__AEQ49755

SEQ ID NO: 112605 - RNA, 1410 nt, Artificial Sequence
  derived and/or modified sequence opt2 from neuraminidase__InfluenzaA__AEQ49756
augaaccccaaccagaagaucaucaccaucggcuccgucugcaugaccaucggcauggccaaccucauccuccagaucggcaacaucaucuccaucuggaucucccacuccauccagcucggcaaccagucccaggucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112606 - RNA, 1410 nt, Artificial Sequence; identical to SEQ ID NO: 112590
  derived and/or modified sequence opt2 from neuraminidase__InfluenzaA__AEQ49757

SEQ ID NO: 112607 - RNA, 1410 nt, Artificial Sequence
  derived and/or modified sequence opt2 from neuraminidase__InfluenzaA__AEQ49758
augaaccccaaccagaagaucaucaccaucggcuccgucugcaugaccaucggcauggccaaccucauccuccagaucggcaacaucaucuccaucuggaucucccacuccauccagcucggcaaccacucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcugggccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112608 - RNA, 1410 nt, Artificial Sequence; identical to SEQ ID NO: 112590
  derived and/or modified sequence opt2 from neuraminidase__InfluenzaA__AEQ49759

SEQ ID NO: 112609 - RNA, 1410 nt, Artificial Sequence; identical to SEQ ID NO: 112590
  derived and/or modified sequence opt2 from neuraminidase__InfluenzaA__AEQ49760

SEQ ID NO: 112610 - RNA, 1410 nt, Artificial Sequence
  derived and/or modified sequence opt2 from neuraminidase__InfluenzaA__AEQ49761
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggcucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgcuccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112611 - RNA, 1410 nt, Artificial Sequence
  derived and/or modified sequence opt2 from neuraminidase__InfluenzaA__AEQ49762
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggaucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaucaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112612 - RNA, 1410 nt, Artificial Sequence; identical to SEQ ID NO: 112590
  derived and/or modified sequence opt2 from neuraminidase__InfluenzaA__AEQ49763

SEQ ID NO: 112613 - RNA, 1410 nt, Artificial Sequence; identical to SEQ ID NO: 112590
  derived and/or modified sequence opt2 from neuraminidase__InfluenzaA__AEQ49764

SEQ ID NO: 112614 - RNA, 1410 nt, Artificial Sequence; identical to SEQ ID NO: 112590
  derived and/or modified sequence opt2 from neuraminidase__InfluenzaA__AEQ49765

SEQ ID NO: 112615 - RNA, 1410 nt, Artificial Sequence
  derived and/or modified sequence opt2 from neuraminidase__InfluenzaA__AEQ49766
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucaccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112616 - RNA, 1410 nt, Artificial Sequence
  derived and/or modified sequence opt2 from neuraminidase__InfluenzaA__AEQ49767
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuucaagaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuacaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcaugggcugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112617 - RNA, 1410 nt, Artificial Sequence; identical to SEQ ID NO: 111769
  derived and/or modified sequence opt2 from neuraminidase__InfluenzaA__AEQ49768

SEQ ID NO: 112618 - RNA, 1410 nt, Artificial Sequence; identical to SEQ ID NO: 112590
  derived and/or modified sequence opt2 from neuraminidase__InfluenzaA__AEQ49769

SEQ ID NO: 112619 - RNA, 1410 nt, Artificial Sequence
  derived and/or modified sequence opt2 from neuraminidase__InfluenzaA__AEQ49770
augaaccccaaccagaagaucaucaccaucggcuccgucugcaugaccaucggcauggccaaccucauccuccagaucggcaacaucaucuccgucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccgucgacaaguga

SEQ ID NO: 112620 - RNA, 1410 nt, Artificial Sequence; identical to SEQ ID NO: 112603
  derived and/or modified sequence opt2 from neuraminidase__InfluenzaA__AEQ49771

SEQ ID NO: 112621 - RNA, 1410 nt, Artificial Sequence; identical to SEQ ID NO: 111769
  derived and/or modified sequence opt2 from neuraminidase__InfluenzaA__AEQ49772

SEQ ID NO: 112622 - RNA, 1410 nt, Artificial Sequence
  derived and/or modified sequence opt2 from neuraminidase__InfluenzaA__AEQ49773
augaaccccaaccagaagaucaucaccaucggcuccaucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccaacaccgucggcugguccuggcccgacggcgccgagcuccccuucaccaucgacaaguga

SEQ ID NO: 112623 - RNA, 1410 nt, Artificial Sequence
  derived and/or modified sequence opt2 from neuraminidase__InfluenzaA__AEQ49774
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgaguacaacaccugggucaaccagaccuacaucaacaucuccaacaccaacuucgccgccggccaguccgucgucuccgucaagcucgucggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuacgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112624 - RNA, 1410 nt, Artificial Sequence; identical to SEQ ID NO: 111769
  derived and/or modified sequence opt2 from neuraminidase__InfluenzaA__AEQ49775

SEQ ID NO: 112625 - RNA, 1410 nt, Artificial Sequence
  derived and/or modified sequence opt2 from neuraminidase__InfluenzaA__AEQ49776
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaccgagaacaccaucuggaccuccggcuccuccaucuccuucugcggcgucaacuccgacaccgucggcugguccuggcccgacggcgccgagcuccccuucaccaucgacaaguga

SEQ ID NO: 112626 - RNA, 1410 nt, Artificial Sequence; identical to SEQ ID NO: 112590
  derived and/or modified sequence opt2 from neuraminidase__InfluenzaA__AEQ49777

SEQ ID NO: 112627 - RNA, 1410 nt, Artificial Sequence
  derived and/or modified sequence opt2 from neuraminidase__InfluenzaA__AEQ49778
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggaucaaccagaccuacgucaacaucuccaacaccaacuucgccgccguccaguccgucgucuccgucaagcucgccggcaacuccacccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112628 - RNA, 1410 nt, Artificial Sequence
  derived and/or modified sequence opt2 from neuraminidase__InfluenzaA__AEQ49779
augaaccccaaccagaagaucaucaccaucggcuccgucugcaugaccaucggcauggccaaccucauccuccagaucggcaacaucaucuccaucuggaucucccacuccauccagcucggcaaccagaaccagaccgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccgucgacaaguga

SEQ ID NO: 112629 - RNA, 1410 nt, Artificial Sequence; identical to SEQ ID NO: 111769
  derived and/or modified sequence opt2 from neuraminidase__InfluenzaA__AEQ49780

SEQ ID NO: 112630 - RNA, 1410 nt, Artificial Sequence; identical to SEQ ID NO: 111769
  derived and/or modified sequence opt2 from neuraminidase__InfluenzaA__AEQ49781

SEQ ID NO: 112631 - RNA, 1410 nt, Artificial Sequence; identical to SEQ ID NO: 112590
  derived and/or modified sequence opt2 from neuraminidase__InfluenzaA__AEQ49782

SEQ ID NO: 112632 - RNA, 1410 nt, Artificial Sequence
  derived and/or modified sequence opt2 from neuraminidase__InfluenzaA__AEQ49783
augaaccccaaccagaagaucaucaccaucggcuccgccugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112633 - RNA, 1410 nt, Artificial Sequence
  derived and/or modified sequence opt2 from neuraminidase__InfluenzaA__AEQ49785
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggcuccaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112634 - RNA, 1410 nt, Artificial Sequence; identical to SEQ ID NO: 112633
  derived and/or modified sequence opt2 from neuraminidase__InfluenzaA__AEQ49786

SEQ ID NO: 112635 - RNA, 1410 nt, Artificial Sequence; identical to SEQ ID NO: 112633
  derived and/or modified sequence opt2 from neuraminidase__InfluenzaA__AEQ49788

SEQ ID NO: 112636 - RNA, 1410 nt, Artificial Sequence; identical to SEQ ID NO: 112633
  derived and/or modified sequence opt2 from neuraminidase__InfluenzaA__AEQ49789

SEQ ID NO: 112637 - RNA, 1410 nt, Artificial Sequence
  derived and/or modified sequence opt2 from neuraminidase__InfluenzaA__AEQ49790
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112638 - RNA, 1410 nt, Artificial Sequence
  derived and/or modified sequence opt2 from neuraminidase__InfluenzaA__AEQ49791
augaaccccaaccagaagaucaucaccaucggcuccgucucccucaccaucuccaccaucugcuucuucaugcagaucgccauccucaucaccaccgucacccuccacuucaagcaguacgaguucuaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112639 - RNA, 1410 nt, Artificial Sequence; identical to SEQ ID NO: 112633
  derived and/or modified sequence opt2 from neuraminidase__InfluenzaA__AEQ49792

SEQ ID NO: 112640 - RNA, 1410 nt, Artificial Sequence; identical to SEQ ID NO: 112633
  derived and/or modified sequence opt2 from neuraminidase__InfluenzaA__AEQ49793

SEQ ID NO: 112641 - RNA, 1410 nt, Artificial Sequence; identical to SEQ ID NO: 112633
  derived and/or modified sequence opt2 from neuraminidase__InfluenzaA__AEQ49794

SEQ ID NO: 112642 - RNA, 1410 nt, Artificial Sequence; identical to SEQ ID NO: 112633
  derived and/or modified sequence opt2 from neuraminidase__InfluenzaA__AEQ49795

SEQ ID NO: 112643 - RNA, 1410 nt, Artificial Sequence
  derived and/or modified sequence opt2 from neuraminidase__InfluenzaA__AEQ49796
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112644 - RNA, 1410 nt, Artificial Sequence; identical to SEQ ID NO: 112633
  derived and/or modified sequence opt2 from neuraminidase__InfluenzaA__AEQ49797

SEQ ID NO: 112645 - RNA, 1410 nt, Artificial Sequence; identical to SEQ ID NO: 112633
  derived and/or modified sequence opt2 from neuraminidase__InfluenzaA__AEQ49798

SEQ ID NO: 112646 - RNA, 1410 nt, Artificial Sequence; identical to SEQ ID NO: 112633
  derived and/or modified sequence opt2 from neuraminidase__InfluenzaA__AEQ49799

SEQ ID NO: 112647 - RNA, 1410 nt, Artificial Sequence; identical to SEQ ID NO: 112633
  derived and/or modified sequence opt2 from neuraminidase__InfluenzaA__AEQ49800

SEQ ID NO: 112648 - RNA, 1410 nt, Artificial Sequence; identical to SEQ ID NO: 112633
  derived and/or modified sequence opt2 from neuraminidase__InfluenzaA__AEQ49801

SEQ ID NO: 112649 - RNA, 1410 nt, Artificial Sequence; identical to SEQ ID NO: 112633
  derived and/or modified sequence opt2 from neuraminidase__InfluenzaA__AEQ49802

SEQ ID NO: 112650 - RNA, 1410 nt, Artificial Sequence
  derived and/or modified sequence opt2 from neuraminidase__InfluenzaA__AEQ49803
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccaccuccuccucccacugccucgaccccaacaacgaggagggcggccacggcgucaagggcugggccuucgacgacggcaacgacgucuggaugggccgcaccaucuccgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugaccaucuga

SEQ ID NO: 112651 - RNA, 1410 nt, Artificial Sequence
  derived and/or modified sequence opt2 from neuraminidase__InfluenzaA__AEQ49804
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112652 - RNA, 1410 nt, Artificial Sequence
  derived and/or modified sequence opt2 from neuraminidase__InfluenzaA__AEQ49805
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggacauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112653 - RNA, 1410 nt, Artificial Sequence
  derived and/or modified sequence opt2 from neuraminidase__InfluenzaA__AEQ49806
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112654 - RNA, 1410 nt, Artificial Sequence; identical to SEQ ID NO: 111030
  derived and/or modified sequence opt2 from neuraminidase__InfluenzaA__AEQ49807

SEQ ID NO: 112655 - RNA, 1410 nt, Artificial Sequence
  derived and/or modified sequence opt2 from neuraminidase__InfluenzaA__AEQ49809
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112656 - RNA, 1410 nt, Artificial Sequence; identical to SEQ ID NO: 112655
  derived and/or modified sequence opt2 from neuraminidase__InfluenzaA__AEQ49811

SEQ ID NO: 112657 - RNA, 1410 nt, Artificial Sequence; identical to SEQ ID NO: 111030
  derived and/or modified sequence opt2 from neuraminidase__InfluenzaA__AEQ49812

SEQ ID NO: 112658 - RNA, 1410 nt, Artificial Sequence; identical to SEQ ID NO: 111030
  derived and/or modified sequence opt2 from neuraminidase__InfluenzaA__AEQ49813

SEQ ID NO: 112659 - RNA, 1410 nt, Artificial Sequence; identical to SEQ ID NO: 111030
  derived and/or modified sequence opt2 from neuraminidase__InfluenzaA__AEQ49815

SEQ ID NO: 112660 - RNA, 1410 nt, Artificial Sequence
  derived and/or modified sequence opt2 from neuraminidase__InfluenzaA__AEQ49816
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucgucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112661 - RNA, 1410 nt, Artificial Sequence; identical to SEQ ID NO: 112395
  derived and/or modified sequence opt2 from neuraminidase__InfluenzaA__AEQ49820

SEQ ID NO: 112662 - RNA, 1410 nt, Artificial Sequence; identical to SEQ ID NO: 112395
  derived and/or modified sequence opt2 from neuraminidase__InfluenzaA__AEQ49821

SEQ ID NO: 112663 - RNA, 1410 nt, Artificial Sequence; identical to SEQ ID NO: 112633
  derived and/or modified sequence opt2 from neuraminidase__InfluenzaA__AEQ49822

SEQ ID NO: 112664 - RNA, 1410 nt, Artificial Sequence; identical to SEQ ID NO: 112633
  derived and/or modified sequence opt2 from neuraminidase__InfluenzaA__AEQ49823

SEQ ID NO: 112665 - RNA, 1410 nt, Artificial Sequence; identical to SEQ ID NO: 112633
  derived and/or modified sequence opt2 from neuraminidase__InfluenzaA__AEQ49824

SEQ ID NO: 112666 - RNA, 1410 nt, Artificial Sequence; identical to SEQ ID NO: 112633
  derived and/or modified sequence opt2 from neuraminidase__InfluenzaA__AEQ49825

SEQ ID NO: 112667 - RNA, 1410 nt, Artificial Sequence; identical to SEQ ID NO: 112633
  derived and/or modified sequence opt2 from neuraminidase__InfluenzaA__AEQ49826

SEQ ID NO: 112668 - RNA, 1410 nt, Artificial Sequence; identical to SEQ ID NO: 112633
  derived and/or modified sequence opt2 from neuraminidase__InfluenzaA__AEQ49827

SEQ ID NO: 112669 - RNA, 1410 nt, Artificial Sequence; identical to SEQ ID NO: 112633
  derived and/or modified sequence opt2 from neuraminidase__InfluenzaA__AEQ49828

SEQ ID NO: 112670 - RNA, 1410 nt, Artificial Sequence
  derived and/or modified sequence opt2 from neuraminidase__InfluenzaA__AEQ49829
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgcccucggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggcuccaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112671 - RNA, 1410 nt, Artificial Sequence; identical to SEQ ID NO: 112633
  derived and/or modified sequence opt2 from neuraminidase__InfluenzaA__AEQ49830

SEQ ID NO: 112672 - RNA, 1410 nt, Artificial Sequence; identical to SEQ ID NO: 112633
  derived and/or modified sequence opt2 from neuraminidase__InfluenzaA__AEQ49831

SEQ ID NO: 112673 - RNA, 1410 nt, Artificial Sequence
  derived and/or modified sequence opt2 from neuraminidase__InfluenzaA__AEQ49832
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucgucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggcuccaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112674 - RNA, 1410 nt, Artificial Sequence
  derived and/or modified sequence opt2 from neuraminidase__InfluenzaA__AEQ49833
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucucccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112675 - RNA, 1410 nt, Artificial Sequence
  derived and/or modified sequence opt2 from neuraminidase__InfluenzaA__AEQ49835
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112676 - RNA, 1410 nt, Artificial Sequence; identical to SEQ ID NO: 112675
  derived and/or modified sequence opt2 from neuraminidase__InfluenzaA__AEQ49836

SEQ ID NO: 112677 - RNA, 1410 nt, Artificial Sequence; identical to SEQ ID NO: 112675
  derived and/or modified sequence opt2 from neuraminidase__InfluenzaA__AEQ49838

SEQ ID NO: 112678 - RNA, 1410 nt, Artificial Sequence; identical to SEQ ID NO: 112675
  derived and/or modified sequence opt2 from neuraminidase__InfluenzaA__AEQ49839

SEQ ID NO: 112679 - RNA, 1410 nt, Artificial Sequence
  derived and/or modified sequence opt2 from neuraminidase__InfluenzaA__AEQ49840
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112680 - RNA, 1410 nt, Artificial Sequence; identical to SEQ ID NO: 112675
  derived and/or modified sequence opt2 from neuraminidase__InfluenzaA__AEQ49841

SEQ ID NO: 112681 - RNA, 1410 nt, Artificial Sequence; identical to SEQ ID NO: 112675
  derived and/or modified sequence opt2 from neuraminidase__InfluenzaA__AEQ49842

SEQ ID NO: 112682 - RNA, 1410 nt, Artificial Sequence; identical to SEQ ID NO: 112675
  derived and/or modified sequence opt2 from neuraminidase__InfluenzaA__AEQ49843

SEQ ID NO: 112683 - RNA, 1410 nt, Artificial Sequence; identical to SEQ ID NO: 112633
  derived and/or modified sequence opt2 from neuraminidase__InfluenzaA__AEQ49844

SEQ ID NO: 112684 - RNA, 1410 nt, Artificial Sequence
  derived and/or modified sequence opt2 from neuraminidase__InfluenzaA__AEQ49845
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagcgcgagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112685 - RNA, 1410 nt, Artificial Sequence
  derived and/or modified sequence opt2 from neuraminidase__InfluenzaA__AEQ49846
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcauggccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaaccucaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112686 - RNA, 1410 nt, Artificial Sequence
  derived and/or modified sequence opt2 from neuraminidase__InfluenzaA__AEQ49850
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggcuccaaggaggagaccgagguccucuggaccuccaacuccaucgucgucuucugcggcaccuccggcaccuacggcaccggcuccuggcccgacggcgccgacaucaagaucaugcccaucuga

SEQ ID NO: 112687 - RNA, 1410 nt, Artificial Sequence
  derived and/or modified sequence opt2 from neuraminidase__InfluenzaA__AEQ49851
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucauggagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112688 - RNA, 1410 nt, Artificial Sequence; identical to SEQ ID NO: 112655
  derived and/or modified sequence opt2 from neuraminidase__InfluenzaA__AEQ49852

SEQ ID NO: 112689 - RNA, 1410 nt, Artificial Sequence; identical to SEQ ID NO: 112633
  derived and/or modified sequence opt2 from neuraminidase__InfluenzaA__AEQ49969

SEQ ID NO: 112690 - RNA, 1410 nt, Artificial Sequence; identical to SEQ ID NO: 112655
  derived and/or modified sequence opt2 from neuraminidase__InfluenzaA__AEQ49970

SEQ ID NO: 112691 - RNA, 1410 nt, Artificial Sequence
  derived and/or modified sequence opt2 from neuraminidase__InfluenzaA__AEQ54954
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112692 - RNA, 1410 nt, Artificial Sequence; identical to SEQ ID NO: 108111
  derived and/or modified sequence opt2 from neuraminidase__InfluenzaA__AER08645

SEQ ID NO: 112693 - RNA, 1410 nt, Artificial Sequence
  derived and/or modified sequence opt2 from neuraminidase__InfluenzaA__AER08649
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagcucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112694 - RNA, 1410 nt, Artificial Sequence
  derived and/or modified sequence opt2 from neuraminidase__InfluenzaA__AER08657
augaaccccaaccagaagaucaucaccaucggcuccgucucccucaccaucuccaccgucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaugugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112695 - RNA, 1410 nt, Artificial Sequence; identical to SEQ ID NO: 108111
  derived and/or modified sequence opt2 from neuraminidase__InfluenzaA__AER08659

SEQ ID NO: 112696 - RNA, 1410 nt, Artificial Sequence
  derived and/or modified sequence opt2 from neuraminidase__InfluenzaA__AER08661
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112697 - RNA, 1410 nt, Artificial Sequence; identical to SEQ ID NO: 111030
  derived and/or modified sequence opt2 from neuraminidase__InfluenzaA__AER08663

SEQ ID NO: 112698 - RNA, 1410 nt, Artificial Sequence; identical to SEQ ID NO: 111030
  derived and/or modified sequence opt2 from neuraminidase__InfluenzaA__AER08665

SEQ ID NO: 112699 - RNA, 1410 nt, Artificial Sequence
  derived and/or modified sequence opt2 from neuraminidase__InfluenzaA__AER08669
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccacccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112700 - RNA, 1410 nt, Artificial Sequence
  derived and/or modified sequence opt2 from neuraminidase__InfluenzaA__AER08671
augaaccccaaccagaagaucaucaccaucggcuccgucucccucaccaucuccaccaucugcuucuucaugcagaucgccauccucaucaccaccgucacccuccacuucaagcaguacggcuucaacuccccccccaacaaccaggucaugcucugcgagcccaccaucaucgagcgcaacaucaccgagaucgucuaccucaccaacaccaccaucgagaaggagaucugccccacccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112701 - RNA, 1410 nt, Artificial Sequence; identical to SEQ ID NO: 111030
  derived and/or modified sequence opt2 from neuraminidase__InfluenzaA__AER08673

SEQ ID NO: 112702 - RNA, 1410 nt, Artificial Sequence; identical to SEQ ID NO: 111030
  derived and/or modified sequence opt2 from neuraminidase__InfluenzaA__AER08675

SEQ ID NO: 112703 - RNA, 1410 nt, Artificial Sequence; identical to SEQ ID NO: 111030
  derived and/or modified sequence opt2 from neuraminidase__InfluenzaA__AER08677

SEQ ID NO: 112704 - RNA, 1410 nt, Artificial Sequence; identical to SEQ ID NO: 111030
  derived and/or modified sequence opt2 from neuraminidase__InfluenzaA__AER08679

SEQ ID NO: 112705 - RNA, 1410 nt, Artificial Sequence
  derived and/or modified sequence opt2 from neuraminidase__InfluenzaA__AER08681
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacgacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112706 - RNA, 1410 nt, Artificial Sequence; identical to SEQ ID NO: 111030
  derived and/or modified sequence opt2 from neuraminidase__InfluenzaA__AER08683

SEQ ID NO: 112707 - RNA, 1410 nt, Artificial Sequence; identical to SEQ ID NO: 112655
  derived and/or modified sequence opt2 from neuraminidase__InfluenzaA__AER08685

SEQ ID NO: 112708 - RNA, 1410 nt, Artificial Sequence; identical to SEQ ID NO: 112655
  derived and/or modified sequence opt2 from neuraminidase__InfluenzaA__AER08687

SEQ ID NO: 112709 - RNA, 1410 nt, Artificial Sequence
  derived and/or modified sequence opt2 from neuraminidase__InfluenzaA__AER08689
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucacccucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaaggacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112710 - RNA, 1410 nt, Artificial Sequence; identical to SEQ ID NO: 112655
  derived and/or modified sequence opt2 from neuraminidase__InfluenzaA__AER08691

SEQ ID NO: 112711 - RNA, 1410 nt, Artificial Sequence
  derived and/or modified sequence opt2 from neuraminidase__InfluenzaA__AER08693
augaaccccaaccagaagaucaucaccaucggcuccgucucccucaccaucuccaccaucugcuucuucaugcagaucgccauccucaucaccaccgucacccuccacuucaagcaguacgaguucaacuccccccccaagaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112712 - RNA, 1410 nt, Artificial Sequence
  derived and/or modified sequence opt2 from neuraminidase__InfluenzaA__AER08697
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaccugccccacccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgucaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 112713 - RNA, 1410 nt, Artificial Sequence; identical to SEQ ID NO: 112509
  derived and/or modified sequence opt2 from neuraminidase__InfluenzaA__AER92714

SEQ ID NO: 112714 - RNA, 1410 nt, Artificial Sequence; identical to SEQ ID NO: 108250
  derived and/or modified sequence opt2 from neuraminidase__InfluenzaA__AER92721

SEQ ID NO: 112715 - RNA, 1410 nt, Artificial Sequence; identical to SEQ ID NO: 108250
  derived and/or modified sequence opt2 from neuraminidase__InfluenzaA__AER92724

SEQ ID NO: 112716 - RNA, 1413 nt, Artificial Sequence
  derived and/or modified sequence opt2 from neuraminidase__InfluenzaA__AET84165
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucuccgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccaucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112717 - RNA, 1413 nt, Artificial Sequence; identical to SEQ ID NO: 110442
  derived and/or modified sequence opt2 from neuraminidase__InfluenzaA__AET84176

SEQ ID NO: 112718 - RNA, 1413 nt, Artificial Sequence
  derived and/or modified sequence opt2 from neuraminidase__InfluenzaA__AET84187
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcauggacuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccaucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112719 - RNA, 1413 nt, Artificial Sequence
  derived and/or modified sequence opt2 from neuraminidase__InfluenzaA__AET84198
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112720 - RNA, 1413 nt, Artificial Sequence
  derived and/or modified sequence opt2 from neuraminidase__InfluenzaA__AET84209
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaaggucgucgccggcgaggacaagaccuccgucacccucgccggcaacuccucccucugcuccaucuccggcugggccaucaacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112721 - RNA, 1413 nt, Artificial Sequence
  derived and/or modified sequence opt2 from neuraminidase__InfluenzaA__AET84231
augaaccccaaccagaagaucaucaccaucggcuccaucuccaucgccaucggcaucaucucccucaugcuccagaucggcuccaucaucuccaucugggccucccacuccauccacaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccuccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112722 - RNA, 1413 nt, Artificial Sequence; identical to SEQ ID NO: 108973
  derived and/or modified sequence opt2 from neuraminidase__InfluenzaA__AET84242

SEQ ID NO: 112723 - RNA, 1413 nt, Artificial Sequence
  derived and/or modified sequence opt2 from neuraminidase__InfluenzaA__AET84253
augaaccccaaccagaagaucaucaccaucggcuccaucuccaucgccaucggcaucaucucccucaugcuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112724 - RNA, 1413 nt, Artificial Sequence
  derived and/or modified sequence opt2 from neuraminidase__InfluenzaA__AET84264
augaaccccaaccagaagaucaucaccaucggcuccaucuccaucgccaucggcaucaucucccucauguuccagaucggcuccaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112725 - RNA, 1413 nt, Artificial Sequence
  derived and/or modified sequence opt2 from neuraminidase__InfluenzaA__AET84275
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112726 - RNA, 1413 nt, Artificial Sequence; identical to SEQ ID NO: 108973
  derived and/or modified sequence opt2 from neuraminidase__InfluenzaA__AET84286

SEQ ID NO: 112727 - RNA, 1413 nt, Artificial Sequence
  derived and/or modified sequence opt2 from neuraminidase__InfluenzaA__AET84297
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccaccaacugguccuggcccgacggcgccgagcuccccuucaccaucgacaaguga

SEQ ID NO: 112728 - RNA, 1413 nt, Artificial Sequence
  derived and/or modified sequence opt2 from neuraminidase__InfluenzaA__AET84308
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccaccaacugguccuggcccgacggcgccgagcuccccuucaccaucgacaaguga

SEQ ID NO: 112729 - RNA, 1413 nt, Artificial Sequence
  derived and/or modified sequence opt2 from neuraminidase__InfluenzaA__AET84319
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaaccgcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112730 - RNA, 1413 nt, Artificial Sequence
  derived and/or modified sequence opt2 from neuraminidase__InfluenzaA__AET84330
augaaccccaaccagcgcaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112731 - RNA, 1413 nt, Artificial Sequence
  derived and/or modified sequence opt2 from neuraminidase__InfluenzaA__AET84341
augaaccccaaccagcgcaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccuccccaaggagaacaccaccaucuggaccuccggcuccuccaucuccuucugcggcgucaacuccgacaccgccaacugguccuggcccgacggcgccgagcuccccuucaccaucgacaaguga

SEQ ID NO: 112732 - RNA, 1413 nt, Artificial Sequence
  derived and/or modified sequence opt2 from neuraminidase__InfluenzaA__AET84363
augaaccccaaccagcgcaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112733 - RNA, 1413 nt, Artificial Sequence
  derived and/or modified sequence opt2 from neuraminidase__InfluenzaA__AET84374
augaaccccaaccagcgcaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112734 - RNA, 1413 nt, Artificial Sequence
  derived and/or modified sequence opt2 from neuraminidase__InfluenzaA__AET84396
augaaccccaaccagcgcaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccaugacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112735 - RNA, 1413 nt, Artificial Sequence
  derived and/or modified sequence opt2 from neuraminidase__InfluenzaA__AET84407
augaaccccaaccagcgcaucaucaccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112736 - RNA, 1413 nt, Artificial Sequence
  derived and/or modified sequence opt2 from neuraminidase__InfluenzaA__AET84418
augaaccccaaccagcgcaucaucgccaucggcuccaucuccaucgccaucggcaucaucucccucaugcuccagaucggcaacaucaucuccaucugggccucccacuccauccagaucggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgccaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112737 - RNA, 1413 nt, Artificial Sequence
  derived and/or modified sequence opt2 from neuraminidase__InfluenzaA__AET84429
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucuccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccaggaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112738 - RNA, 1413 nt, Artificial Sequence
  derived and/or modified sequence opt2 from neuraminidase__InfluenzaA__AET84440
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112739 - RNA, 1413 nt, Artificial Sequence
  derived and/or modified sequence opt2 from neuraminidase__InfluenzaA__AET84451
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucaccaagggcgcccuccucaacgacaagcacuccaacggcaccgucaccgaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 112740 - RNA, 1410 nt, Artificial Sequence; identical to SEQ ID NO: 108250
  derived and/or modified sequence opt2 from neuraminidase__InfluenzaA__AEV53421

SEQ ID NO: 112741 - RNA, 1410 nt, Artificial Sequence; identical to SEQ ID NO: 108250
  derived and/or modified sequence opt2 from neuraminidase__InfluenzaA__AEV53423

SEQ ID NO: 112742 - RNA, 1410 nt, Artificial Sequence; identical to SEQ ID NO: 109712
  derived and/or modified sequence opt2 from neuraminidase__InfluenzaA__AEV53425

SEQ ID NO: 112743 - RNA, 1410 nt, Artificial Sequence; identical to SEQ ID NO: 108250
  derived and/or modified sequence opt2 from neuraminidase__InfluenzaA__AEV53427

SEQ ID NO: 112744 - RNA, 1410 nt, Artificial Sequence; identical to SEQ ID NO: 109712
  derived and/or modified sequence opt2 from neuraminidase__InfluenzaA__AEV53429

SEQ ID NO: 112745 - RNA, 1410 nt, Artificial Sequence
  derived and/or modified sequence opt2 from neuraminidase__InfluenzaA__AEV53431
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucguccccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 112746 - RNA, 1410 nt, Artificial Sequence; identical to SEQ ID NO: 108250
  derived and/or modified sequence opt2 from neuraminidase__InfluenzaA__AEV53435

SEQ ID NO: 112747 - RNA, 1410 nt, Artificial Sequence
  derived and/or modified sequence opt2 from neuraminidase__InfluenzaA__AEV53437
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacacccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112748 - RNA, 1410 nt, Artificial Sequence; identical to SEQ ID NO: 108250
  derived and/or modified sequence opt2 from neuraminidase__InfluenzaA__AEV53439

SEQ ID NO: 112749 - RNA, 1410 nt, Artificial Sequence; identical to SEQ ID NO: 108250
  derived and/or modified sequence opt2 from neuraminidase__InfluenzaA__AEV53441

SEQ ID NO: 112750 - RNA, 1410 nt, Artificial Sequence; identical to SEQ ID NO: 108250
  derived and/or modified sequence opt2 from neuraminidase__InfluenzaA__AEV53443

SEQ ID NO: 112751 - RNA, 1410 nt, Artificial Sequence
  derived and/or modified sequence opt2 from neuraminidase__InfluenzaA__AEV53445
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgaccacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112752 - RNA, 1410 nt, Artificial Sequence; identical to SEQ ID NO: 108250
  derived and/or modified sequence opt2 from neuraminidase__InfluenzaA__AEV53447

SEQ ID NO: 112753 - RNA, 1410 nt, Artificial Sequence; identical to SEQ ID NO: 110152
  derived and/or modified sequence opt2 from neuraminidase__InfluenzaA__AEV53449

SEQ ID NO: 112754 - RNA, 1410 nt, Artificial Sequence
  derived and/or modified sequence opt2 from neuraminidase__InfluenzaA__AEV53451
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuucaagaucgagaagggcaagaucgucaaguccgucgagaugaacgcccccgacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112755 - RNA, 1410 nt, Artificial Sequence; identical to SEQ ID NO: 108250
  derived and/or modified sequence opt2 from neuraminidase__InfluenzaA__AEV53453

SEQ ID NO: 112756 - RNA, 1410 nt, Artificial Sequence
  derived and/or modified sequence opt2 from neuraminidase__InfluenzaA__AEV53455
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112757 - RNA, 1410 nt, Artificial Sequence
  derived and/or modified sequence opt2 from neuraminidase__InfluenzaA__AEV53457
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcgucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112758 - RNA, 1410 nt, Artificial Sequence
  derived and/or modified sequence opt2 from neuraminidase__InfluenzaA__AEV53459
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaucaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112759 - RNA, 1410 nt, Artificial Sequence; identical to SEQ ID NO: 108250
  derived and/or modified sequence opt2 from neuraminidase__InfluenzaA__AEV53461

SEQ ID NO: 112760 - RNA, 1410 nt, Artificial Sequence
  derived and/or modified sequence opt2 from neuraminidase__InfluenzaA__AEV53463
augaaccccaaccagaagaucaucaccaucggcuccgucugcaugaccaucggcauggccaaccucauccuccagaucggcaacaucaucuccaucuggaucucccacuccauccagcucgagaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcaucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112761 - RNA, 1410 nt, Artificial Sequence
  derived and/or modified sequence opt2 from neuraminidase__InfluenzaA__AEV53465
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgaccgccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuacaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112762 - RNA, 1410 nt, Artificial Sequence; identical to SEQ ID NO: 110051
  derived and/or modified sequence opt2 from neuraminidase__InfluenzaA__AEV53467

SEQ ID NO: 112763 - RNA, 1410 nt, Artificial Sequence; identical to SEQ ID NO: 110051
  derived and/or modified sequence opt2 from neuraminidase__InfluenzaA__AEV53469

SEQ ID NO: 112764 - RNA, 1410 nt, Artificial Sequence; identical to SEQ ID NO: 108250
  derived and/or modified sequence opt2 from neuraminidase__InfluenzaA__AEV53471

SEQ ID NO: 112765 - RNA, 1410 nt, Artificial Sequence; identical to SEQ ID NO: 108250
  derived and/or modified sequence opt2 from neuraminidase__InfluenzaA__AEV53473

SEQ ID NO: 112766 - RNA, 1410 nt, Artificial Sequence; identical to SEQ ID NO: 108250
  derived and/or modified sequence opt2 from neuraminidase__InfluenzaA__AEV53475

SEQ ID NO: 112767 - RNA, 1410 nt, Artificial Sequence; identical to SEQ ID NO: 108250
  derived and/or modified sequence opt2 from neuraminidase__InfluenzaA__AEV53477

SEQ ID NO: 112768 - RNA, 1410 nt, Artificial Sequence; identical to SEQ ID NO: 108250
  derived and/or modified sequence opt2 from neuraminidase__InfluenzaA__AEV53479

SEQ ID NO: 112769 - RNA, 1410 nt, Artificial Sequence; identical to SEQ ID NO: 108250
  derived and/or modified sequence opt2 from neuraminidase__InfluenzaA__AEV53481

SEQ ID NO: 112770 - RNA, 1410 nt, Artificial Sequence; identical to SEQ ID NO: 108250
  derived and/or modified sequence opt2 from neuraminidase__InfluenzaA__AEV53483

SEQ ID NO: 112771 - RNA, 1410 nt, Artificial Sequence
  derived and/or modified sequence opt2 from neuraminidase__InfluenzaA__AEV53485
augaaccccaaccagaagaucaucaccaucggcuccgucugcaugaccaucggcauggccaaccucauccuccagaucggcaacaucaucuccaucugggucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112772 - RNA, 1410 nt, Artificial Sequence; identical to SEQ ID NO: 110051
  derived and/or modified sequence opt2 from neuraminidase__InfluenzaA__AEV53487

SEQ ID NO: 112773 - RNA, 1410 nt, Artificial Sequence; identical to SEQ ID NO: 109268
  derived and/or modified sequence opt2 from neuraminidase__InfluenzaA__AEV53489

SEQ ID NO: 112774 - RNA, 1410 nt, Artificial Sequence
  derived and/or modified sequence opt2 from neuraminidase__InfluenzaA__AEV53491
augaaccccaaccagaagaucaucaccaucggccucgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112775 - RNA, 1410 nt, Artificial Sequence; identical to SEQ ID NO: 108250
  derived and/or modified sequence opt2 from neuraminidase__InfluenzaA__AEV53493

SEQ ID NO: 112776 - RNA, 1410 nt, Artificial Sequence; identical to SEQ ID NO: 109712
  derived and/or modified sequence opt2 from neuraminidase__InfluenzaA__AEV53495

SEQ ID NO: 112777 - RNA, 1410 nt, Artificial Sequence
  derived and/or modified sequence opt2 from neuraminidase__InfluenzaA__AEV53497
augaaccccaaccagaagaucaucaccaucggcuccgucugcaugaccaucggcauggccaaccucauccuccagaucggcaacaucaucuccaucuggaucucccacuccauccagcucgagaaccagaaccagaucgagaccugcaaccaguccgucaucaccuacgagaacaacaccugggucaaccagaccuacgucaacaucuccaacaccaacuucgccgccggccaguccgucgucuccgucaaccucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112778 - RNA, 1410 nt, Artificial Sequence; identical to SEQ ID NO: 109268
  derived and/or modified sequence opt2 from neuraminidase__InfluenzaA__AEV53499

SEQ ID NO: 112779 - RNA, 1410 nt, Artificial Sequence; identical to SEQ ID NO: 108250
  derived and/or modified sequence opt2 from neuraminidase__InfluenzaA__AEV53501

SEQ ID NO: 112780 - RNA, 1410 nt, Artificial Sequence; identical to SEQ ID NO: 108250
  derived and/or modified sequence opt2 from neuraminidase__InfluenzaA__AEV53503

SEQ ID NO: 112781 - RNA, 1410 nt, Artificial Sequence; identical to SEQ ID NO: 108250
  derived and/or modified sequence opt2 from neuraminidase__InfluenzaA__AEV53505

SEQ ID NO: 112782 - RNA, 1410 nt, Artificial Sequence; identical to SEQ ID NO: 108250
  derived and/or modified sequence opt2 from neuraminidase__InfluenzaA__AEV53507

SEQ ID NO: 112783 - RNA, 1410 nt, Artificial Sequence; identical to SEQ ID NO: 108250
  derived and/or modified sequence opt2 from neuraminidase__InfluenzaA__AEV53509

SEQ ID NO: 112784 - RNA, 1410 nt, Artificial Sequence; identical to SEQ ID NO: 109712
  derived and/or modified sequence opt2 from neuraminidase__InfluenzaA__AEV53511

SEQ ID NO: 112785 - RNA, 1410 nt, Artificial Sequence; identical to SEQ ID NO: 109712
  derived and/or modified sequence opt2 from neuraminidase__InfluenzaA__AEV53513

SEQ ID NO: 112786 - RNA, 1410 nt, Artificial Sequence; identical to SEQ ID NO: 109712
  derived and/or modified sequence opt2 from neuraminidase__InfluenzaA__AEV53515

SEQ ID NO: 112787 - RNA, 1410 nt, Artificial Sequence
  derived and/or modified sequence opt2 from neuraminidase__InfluenzaA__AEV53517
augaaccccaaccagcgcaucaucaccaucggcuccgucugcaugaccaucggcauggccaaccucauccuccagaucggcaacaucaucuccaucugggucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112788 - RNA, 1410 nt, Artificial Sequence; identical to SEQ ID NO: 108250
  derived and/or modified sequence opt2 from neuraminidase__InfluenzaA__AEV53519

SEQ ID NO: 112789 - RNA, 1410 nt, Artificial Sequence; identical to SEQ ID NO: 109712
  derived and/or modified sequence opt2 from neuraminidase__InfluenzaA__AEV53521

SEQ ID NO: 112790 - RNA, 1410 nt, Artificial Sequence; identical to SEQ ID NO: 109538
  derived and/or modified sequence opt2 from neuraminidase__InfluenzaA__AEV53523

SEQ ID NO: 112791 - RNA, 1410 nt, Artificial Sequence; identical to SEQ ID NO: 108604
  derived and/or modified sequence opt2 from neuraminidase__InfluenzaA__AEV53525

SEQ ID NO: 112792 - RNA, 1410 nt, Artificial Sequence; identical to SEQ ID NO: 108250
  derived and/or modified sequence opt2 from neuraminidase__InfluenzaA__AEV53527

SEQ ID NO: 112793 - RNA, 1410 nt, Artificial Sequence
  derived and/or modified sequence opt2 from neuraminidase__InfluenzaA__AEV53529
augaaccccaaccagaagaucaucaccaucggcuccgucugcaugaccaucggcauggccaaccucauccuccagaucggcaacaucaucuccaucuggaucucccacuccauccagcucgagaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112794 - RNA, 1410 nt, Artificial Sequence; identical to SEQ ID NO: 109712
  derived and/or modified sequence opt2 from neuraminidase__InfluenzaA__AEV53531

SEQ ID NO: 112795 - RNA, 1410 nt, Artificial Sequence
  derived and/or modified sequence opt2 from neuraminidase__InfluenzaA__AEV53533
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112796 - RNA, 1410 nt, Artificial Sequence; identical to SEQ ID NO: 108250
  derived and/or modified sequence opt2 from neuraminidase__InfluenzaA__AEV53535

SEQ ID NO: 112797 - RNA, 1410 nt, Artificial Sequence; identical to SEQ ID NO: 112771
  derived and/or modified sequence opt2 from neuraminidase__InfluenzaA__AEV53537

SEQ ID NO: 112798 - RNA, 1410 nt, Artificial Sequence; identical to SEQ ID NO: 108250
  derived and/or modified sequence opt2 from neuraminidase__InfluenzaA__AEV53539

SEQ ID NO: 112799 - RNA, 1410 nt, Artificial Sequence; identical to SEQ ID NO: 111689
  derived and/or modified sequence opt2 from neuraminidase__InfluenzaA__AEV53541

SEQ ID NO: 112800 - RNA, 1410 nt, Artificial Sequence; identical to SEQ ID NO: 111689
  derived and/or modified sequence opt2 from neuraminidase__InfluenzaA__AEV53543

SEQ ID NO: 112801 - RNA, 1410 nt, Artificial Sequence; identical to SEQ ID NO: 109898
  derived and/or modified sequence opt2 from neuraminidase__InfluenzaA__AEV53545

SEQ ID NO: 112802 - RNA, 1410 nt, Artificial Sequence; identical to SEQ ID NO: 111689
  derived and/or modified sequence opt2 from neuraminidase__InfluenzaA__AEV53547

SEQ ID NO: 112803 - RNA, 1410 nt, Artificial Sequence; identical to SEQ ID NO: 111689
  derived and/or modified sequence opt2 from neuraminidase__InfluenzaA__AEV53549

SEQ ID NO: 112804 - RNA, 1410 nt, Artificial Sequence; identical to SEQ ID NO: 111689
  derived and/or modified sequence opt2 from neuraminidase__InfluenzaA__AEV53551

SEQ ID NO: 112805 - RNA, 1410 nt, Artificial Sequence; identical to SEQ ID NO: 111689
  derived and/or modified sequence opt2 from neuraminidase__InfluenzaA__AEV53553

SEQ ID NO: 112806 - RNA, 1410 nt, Artificial Sequence; identical to SEQ ID NO: 112771
  derived and/or modified sequence opt2 from neuraminidase__InfluenzaA__AEV53555

SEQ ID NO: 112807 - RNA, 1410 nt, Artificial Sequence; identical to SEQ ID NO: 109268
  derived and/or modified sequence opt2 from neuraminidase__InfluenzaA__AEV53557

SEQ ID NO: 112808 - RNA, 1410 nt, Artificial Sequence; identical to SEQ ID NO: 108250
  derived and/or modified sequence opt2 from neuraminidase__InfluenzaA__AEV53559

SEQ ID NO: 112809 - RNA, 1410 nt, Artificial Sequence; identical to SEQ ID NO: 108250
  derived and/or modified sequence opt2 from neuraminidase__InfluenzaA__AEV53561

SEQ ID NO: 112810 - RNA, 1410 nt, Artificial Sequence; identical to SEQ ID NO: 109842
  derived and/or modified sequence opt2 from neuraminidase__InfluenzaA__AEV53563

SEQ ID NO: 112811 - RNA, 1410 nt, Artificial Sequence
  derived and/or modified sequence opt2 from neuraminidase__InfluenzaA__AEV53565
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucaacggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcucccccucaccaucgacaaguga

SEQ ID NO: 112812 - RNA, 1410 nt, Artificial Sequence
  derived and/or modified sequence opt2 from neuraminidase__InfluenzaA__AEV53567
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgccuggaucggccgcaccaaguccaucuccucccgcaacggcuucgagaugaucugggaccccaacggcuggaccgagaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112813 - RNA, 1410 nt, Artificial Sequence; identical to SEQ ID NO: 108250
  derived and/or modified sequence opt2 from neuraminidase__InfluenzaA__AEV53569

SEQ ID NO: 112814 - RNA, 1410 nt, Artificial Sequence; identical to SEQ ID NO: 111689
  derived and/or modified sequence opt2 from neuraminidase__InfluenzaA__AEV53571

SEQ ID NO: 112815 - RNA, 1410 nt, Artificial Sequence; identical to SEQ ID NO: 111689
  derived and/or modified sequence opt2 from neuraminidase__InfluenzaA__AEV53573

SEQ ID NO: 112816 - RNA, 1410 nt, Artificial Sequence; identical to SEQ ID NO: 110051
  derived and/or modified sequence opt2 from neuraminidase__InfluenzaA__AEV53575

SEQ ID NO: 112817 - RNA, 1410 nt, Artificial Sequence
  derived and/or modified sequence opt2 from neuraminidase__InfluenzaA__AEV53577
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcagcccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112818 - RNA, 1410 nt, Artificial Sequence; identical to SEQ ID NO: 112756
  derived and/or modified sequence opt2 from neuraminidase__InfluenzaA__AEV53579

SEQ ID NO: 112819 - RNA, 1410 nt, Artificial Sequence; identical to SEQ ID NO: 110051
  derived and/or modified sequence opt2 from neuraminidase__InfluenzaA__AEV53581

SEQ ID NO: 112820 - RNA, 1410 nt, Artificial Sequence; identical to SEQ ID NO: 109712
  derived and/or modified sequence opt2 from neuraminidase__InfluenzaA__AEV53583

SEQ ID NO: 112821 - RNA, 1410 nt, Artificial Sequence; identical to SEQ ID NO: 109712
  derived and/or modified sequence opt2 from neuraminidase__InfluenzaA__AEV53585

SEQ ID NO: 112822 - RNA, 1410 nt, Artificial Sequence
  derived and/or modified sequence opt2 from neuraminidase__InfluenzaA__AEV76877
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaccaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112823 - RNA, 1410 nt, Artificial Sequence; identical to SEQ ID NO: 108250
  derived and/or modified sequence opt2 from neuraminidase__InfluenzaA__AEW10576

SEQ ID NO: 112824 - RNA, 1410 nt, Artificial Sequence; identical to SEQ ID NO: 108250
  derived and/or modified sequence opt2 from neuraminidase__InfluenzaA__AEW10586

SEQ ID NO: 112825 - RNA, 1410 nt, Artificial Sequence; identical to SEQ ID NO: 108250
  derived and/or modified sequence opt2 from neuraminidase__InfluenzaA__AEW10596

SEQ ID NO: 112826 - RNA, 1410 nt, Artificial Sequence; identical to SEQ ID NO: 108250
  derived and/or modified sequence opt2 from neuraminidase__InfluenzaA__AEW10606

SEQ ID NO: 112827 - RNA, 1410 nt, Artificial Sequence; identical to SEQ ID NO: 109137
  derived and/or modified sequence opt2 from neuraminidase__InfluenzaA__AEW10616

SEQ ID NO: 112828 - RNA, 1410 nt, Artificial Sequence
  derived and/or modified sequence opt2 from neuraminidase__InfluenzaA__AEW10626
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccauggccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112829 - RNA, 1410 nt, Artificial Sequence; identical to SEQ ID NO: 108250
  derived and/or modified sequence opt2 from neuraminidase__InfluenzaA__AEW10636

SEQ ID NO: 112830 - RNA, 1410 nt, Artificial Sequence; identical to SEQ ID NO: 108240
  derived and/or modified sequence opt2 from neuraminidase__InfluenzaA__AEW10646

SEQ ID NO: 112831 - RNA, 1410 nt, Artificial Sequence; identical to SEQ ID NO: 108250
  derived and/or modified sequence opt2 from neuraminidase__InfluenzaA__AEW10656

SEQ ID NO: 112832 - RNA, 1410 nt, Artificial Sequence; identical to SEQ ID NO: 108250
  derived and/or modified sequence opt2 from neuraminidase__InfluenzaA__AEW10666

SEQ ID NO: 112833 - RNA, 1410 nt, Artificial Sequence; identical to SEQ ID NO: 108250
  derived and/or modified sequence opt2 from neuraminidase__InfluenzaA__AEW10676

SEQ ID NO: 112834 - RNA, 1410 nt, Artificial Sequence; identical to SEQ ID NO: 108250
  derived and/or modified sequence opt2 from neuraminidase__InfluenzaA__AEW10686

SEQ ID NO: 112835 - RNA, 1410 nt, Artificial Sequence; identical to SEQ ID NO: 108250
  derived and/or modified sequence opt2 from neuraminidase__InfluenzaA__AEW10696

SEQ ID NO: 112836 - RNA, 1410 nt, Artificial Sequence; identical to SEQ ID NO: 108250
  derived and/or modified sequence opt2 from neuraminidase__InfluenzaA__AEW10706

SEQ ID NO: 112837 - RNA, 1410 nt, Artificial Sequence; identical to SEQ ID NO: 108240
  derived and/or modified sequence opt2 from neuraminidase__InfluenzaA__AEW10716

SEQ ID NO: 112838 - RNA, 1410 nt, Artificial Sequence; identical to SEQ ID NO: 108250
  derived and/or modified sequence opt2 from neuraminidase__InfluenzaA__AEW10726

SEQ ID NO: 112839 - RNA, 1410 nt, Artificial Sequence; identical to SEQ ID NO: 108250
  derived and/or modified sequence opt2 from neuraminidase__InfluenzaA__AEW10736

SEQ ID NO: 112840 - RNA, 1410 nt, Artificial Sequence; identical to SEQ ID NO: 108240
  derived and/or modified sequence opt2 from neuraminidase__InfluenzaA__AEW10746

SEQ ID NO: 112841 - RNA, 1410 nt, Artificial Sequence; identical to SEQ ID NO: 108240
  derived and/or modified sequence opt2 from neuraminidase__InfluenzaA__AEW10756

SEQ ID NO: 112842 - RNA, 1410 nt, Artificial Sequence; identical to SEQ ID NO: 108240
  derived and/or modified sequence opt2 from neuraminidase__InfluenzaA__AEW10766

SEQ ID NO: 112843 - RNA, 1410 nt, Artificial Sequence; identical to SEQ ID NO: 108240
  derived and/or modified sequence opt2 from neuraminidase__InfluenzaA__AEW10776

SEQ ID NO: 112844 - RNA, 1410 nt, Artificial Sequence; identical to SEQ ID NO: 108240
  derived and/or modified sequence opt2 from neuraminidase__InfluenzaA__AEW10786

SEQ ID NO: 112845 - RNA, 1410 nt, Artificial Sequence; identical to SEQ ID NO: 108240
  derived and/or modified sequence opt2 from neuraminidase__InfluenzaA__AEW10796

SEQ ID NO: 112846 - RNA, 1410 nt, Artificial Sequence; identical to SEQ ID NO: 108240
  derived and/or modified sequence opt2 from neuraminidase__InfluenzaA__AEW10806

SEQ ID NO: 112847 - RNA, 1410 nt, Artificial Sequence; identical to SEQ ID NO: 108240
  derived and/or modified sequence opt2 from neuraminidase__InfluenzaA__AEW10816

SEQ ID NO: 112848 - RNA, 1410 nt, Artificial Sequence; identical to SEQ ID NO: 108250
  derived and/or modified sequence opt2 from neuraminidase__InfluenzaA__AEW10826

SEQ ID NO: 112849 - RNA, 1410 nt, Artificial Sequence; identical to SEQ ID NO: 108240
  derived and/or modified sequence opt2 from neuraminidase__InfluenzaA__AEW10836

SEQ ID NO: 112850 - RNA, 1410 nt, Artificial Sequence; identical to SEQ ID NO: 108240
  derived and/or modified sequence opt2 from neuraminidase__InfluenzaA__AEW10846

SEQ ID NO: 112851 - RNA, 1410 nt, Artificial Sequence; identical to SEQ ID NO: 108240
  derived and/or modified sequence opt2 from neuraminidase__InfluenzaA__AEW10856

SEQ ID NO: 112852 - RNA, 1410 nt, Artificial Sequence; identical to SEQ ID NO: 108240
  derived and/or modified sequence opt2 from neuraminidase__InfluenzaA__AEW10866

SEQ ID NO: 112853 - RNA, 1410 nt, Artificial Sequence; identical to SEQ ID NO: 108240
  derived and/or modified sequence opt2 from neuraminidase__InfluenzaA__AEW10876

SEQ ID NO: 112854 - RNA, 1410 nt, Artificial Sequence; identical to SEQ ID NO: 108240
  derived and/or modified sequence opt2 from neuraminidase__InfluenzaA__AEW10886

SEQ ID NO: 112855 - RNA, 1410 nt, Artificial Sequence; identical to SEQ ID NO: 108240
  derived and/or modified sequence opt2 from neuraminidase__InfluenzaA__AEW10896

SEQ ID NO: 112856 - RNA, 1410 nt, Artificial Sequence; identical to SEQ ID NO: 108240
  derived and/or modified sequence opt2 from neuraminidase__InfluenzaA__AEW10906

SEQ ID NO: 112857 - RNA, 1410 nt, Artificial Sequence; identical to SEQ ID NO: 108240
  derived and/or modified sequence opt2 from neuraminidase__InfluenzaA__AEW10916

SEQ ID NO: 112858 - RNA, 1410 nt, Artificial Sequence
  derived and/or modified sequence opt2 from neuraminidase__InfluenzaA__AEW10926
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucaucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112859 - RNA, 1410 nt, Artificial Sequence; identical to SEQ ID NO: 108240
  derived and/or modified sequence opt2 from neuraminidase__InfluenzaA__AEW10936

SEQ ID NO: 112860 - RNA, 1410 nt, Artificial Sequence; identical to SEQ ID NO: 108240
  derived and/or modified sequence opt2 from neuraminidase__InfluenzaA__AEW10946

SEQ ID NO: 112861 - RNA, 1410 nt, Artificial Sequence; identical to SEQ ID NO: 108250
  derived and/or modified sequence opt2 from neuraminidase__InfluenzaA__AEW10956

SEQ ID NO: 112862 - RNA, 1410 nt, Artificial Sequence; identical to SEQ ID NO: 108250
  derived and/or modified sequence opt2 from neuraminidase__InfluenzaA__AEW10966

SEQ ID NO: 112863 - RNA, 1410 nt, Artificial Sequence; identical to SEQ ID NO: 108240
  derived and/or modified sequence opt2 from neuraminidase__InfluenzaA__AEW10976

SEQ ID NO: 112864 - RNA, 1410 nt, Artificial Sequence; identical to SEQ ID NO: 108250
  derived and/or modified sequence opt2 from neuraminidase__InfluenzaA__AEW10986

SEQ ID NO: 112865 - RNA, 1410 nt, Artificial Sequence; identical to SEQ ID NO: 108250
  derived and/or modified sequence opt2 from neuraminidase__InfluenzaA__AEW10996

SEQ ID NO: 112866 - RNA, 1410 nt, Artificial Sequence; identical to SEQ ID NO: 108250
  derived and/or modified sequence opt2 from neuraminidase__InfluenzaA__AEW11006

SEQ ID NO: 112867 - RNA, 1410 nt, Artificial Sequence; identical to SEQ ID NO: 108250
  derived and/or modified sequence opt2 from neuraminidase__InfluenzaA__AEW11016

SEQ ID NO: 112868 - RNA, 1410 nt, Artificial Sequence; identical to SEQ ID NO: 108250
  derived and/or modified sequence opt2 from neuraminidase__InfluenzaA__AEW11026

SEQ ID NO: 112869 - RNA, 1410 nt, Artificial Sequence; identical to SEQ ID NO: 108250
  derived and/or modified sequence opt2 from neuraminidase__InfluenzaA__AEW11036

SEQ ID NO: 112870 - RNA, 1410 nt, Artificial Sequence; identical to SEQ ID NO: 108240
  derived and/or modified sequence opt2 from neuraminidase__InfluenzaA__AEW11046

SEQ ID NO: 112871 - RNA, 1410 nt, Artificial Sequence; identical to SEQ ID NO: 108250
  derived and/or modified sequence opt2 from neuraminidase__InfluenzaA__AEW11056

SEQ ID NO: 112872 - RNA, 1410 nt, Artificial Sequence; identical to SEQ ID NO: 109054
  derived and/or modified sequence opt2 from neuraminidase__InfluenzaA__AEW11066

SEQ ID NO: 112873 - RNA, 1410 nt, Artificial Sequence; identical to SEQ ID NO: 109054
  derived and/or modified sequence opt2 from neuraminidase__InfluenzaA__AEW11076

SEQ ID NO: 112874 - RNA, 1410 nt, Artificial Sequence; identical to SEQ ID NO: 109054
  derived and/or modified sequence opt2 from neuraminidase__InfluenzaA__AEW11086

SEQ ID NO: 112875 - RNA, 1410 nt, Artificial Sequence; identical to SEQ ID NO: 109054
  derived and/or modified sequence opt2 from neuraminidase__InfluenzaA__AEW11096

SEQ ID NO: 112876 - RNA, 1410 nt, Artificial Sequence; identical to SEQ ID NO: 109054
  derived and/or modified sequence opt2 from neuraminidase__InfluenzaA__AEW11106

SEQ ID NO: 112877 - RNA, 1410 nt, Artificial Sequence; identical to SEQ ID NO: 108250
  derived and/or modified sequence opt2 from neuraminidase__InfluenzaA__AEW11116

SEQ ID NO: 112878 - RNA, 1410 nt, Artificial Sequence; identical to SEQ ID NO: 109054
  derived and/or modified sequence opt2 from neuraminidase__InfluenzaA__AEW11126

SEQ ID NO: 112879 - RNA, 1410 nt, Artificial Sequence; identical to SEQ ID NO: 108958
  derived and/or modified sequence opt2 from neuraminidase__InfluenzaA__AEW11136

SEQ ID NO: 112880 - RNA, 1410 nt, Artificial Sequence; identical to SEQ ID NO: 108250
  derived and/or modified sequence opt2 from neuraminidase__InfluenzaA__AEW11146

SEQ ID NO: 112881 - RNA, 1410 nt, Artificial Sequence; identical to SEQ ID NO: 108250
  derived and/or modified sequence opt2 from neuraminidase__InfluenzaA__AEW11156

SEQ ID NO: 112882 - RNA, 1410 nt, Artificial Sequence; identical to SEQ ID NO: 109054
  derived and/or modified sequence opt2 from neuraminidase__InfluenzaA__AEW11166

SEQ ID NO: 112883 - RNA, 1410 nt, Artificial Sequence; identical to SEQ ID NO: 109054
  derived and/or modified sequence opt2 from neuraminidase__InfluenzaA__AEW11176

SEQ ID NO: 112884 - RNA, 1410 nt, Artificial Sequence; identical to SEQ ID NO: 108250
  derived and/or modified sequence opt2 from neuraminidase__InfluenzaA__AEW11186

SEQ ID NO: 112885 - RNA, 1410 nt, Artificial Sequence; identical to SEQ ID NO: 109054
  derived and/or modified sequence opt2 from neuraminidase__InfluenzaA__AEW11196

SEQ ID NO: 112886 - RNA, 1410 nt, Artificial Sequence; identical to SEQ ID NO: 108250
  derived and/or modified sequence opt2 from neuraminidase__InfluenzaA__AEW11206

SEQ ID NO: 112887 - RNA, 1410 nt, Artificial Sequence; identical to SEQ ID NO: 108250
  derived and/or modified sequence opt2 from neuraminidase__InfluenzaA__AEW11216

SEQ ID NO: 112888 - RNA, 1410 nt, Artificial Sequence; identical to SEQ ID NO: 108958
  derived and/or modified sequence opt2 from neuraminidase__InfluenzaA__AEW11226

SEQ ID NO: 112889 - RNA, 1410 nt, Artificial Sequence; identical to SEQ ID NO: 108250
  derived and/or modified sequence opt2 from neuraminidase__InfluenzaA__AEW11236

SEQ ID NO: 112890 - RNA, 1410 nt, Artificial Sequence; identical to SEQ ID NO: 108250
  derived and/or modified sequence opt2 from neuraminidase__InfluenzaA__AEW11246

SEQ ID NO: 112891 - RNA, 1410 nt, Artificial Sequence; identical to SEQ ID NO: 109054
  derived and/or modified sequence opt2 from neuraminidase__InfluenzaA__AEW11255

SEQ ID NO: 112892 - RNA, 1410 nt, Artificial Sequence; identical to SEQ ID NO: 109054
  derived and/or modified sequence opt2 from neuraminidase__InfluenzaA__AEW11265

SEQ ID NO: 112893 - RNA, 1410 nt, Artificial Sequence; identical to SEQ ID NO: 108250
  derived and/or modified sequence opt2 from neuraminidase__InfluenzaA__AEW11275

SEQ ID NO: 112894 - RNA, 1410 nt, Artificial Sequence
  derived and/or modified sequence opt2 from neuraminidase__InfluenzaA__AEW11285
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagaaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112895 - RNA, 1410 nt, Artificial Sequence; identical to SEQ ID NO: 109054
  derived and/or modified sequence opt2 from neuraminidase__InfluenzaA__AEW11295

SEQ ID NO: 112896 - RNA, 1410 nt, Artificial Sequence; identical to SEQ ID NO: 108250
  derived and/or modified sequence opt2 from neuraminidase__InfluenzaA__AEW11305

SEQ ID NO: 112897 - RNA, 1410 nt, Artificial Sequence; identical to SEQ ID NO: 109054
  derived and/or modified sequence opt2 from neuraminidase__InfluenzaA__AEW11315

SEQ ID NO: 112898 - RNA, 1410 nt, Artificial Sequence; identical to SEQ ID NO: 108250
  derived and/or modified sequence opt2 from neuraminidase__InfluenzaA__AEW11325

SEQ ID NO: 112899 - RNA, 1410 nt, Artificial Sequence; identical to SEQ ID NO: 108250
  derived and/or modified sequence opt2 from neuraminidase__InfluenzaA__AEW25299

SEQ ID NO: 112900 - RNA, 1410 nt, Artificial Sequence; identical to SEQ ID NO: 108250
  derived and/or modified sequence opt2 from neuraminidase__InfluenzaA__AEW25308

SEQ ID NO: 112901 - RNA, 1410 nt, Artificial Sequence; identical to SEQ ID NO: 109323
  derived and/or modified sequence opt2 from neuraminidase__InfluenzaA__AEW25317

SEQ ID NO: 112902 - RNA, 1410 nt, Artificial Sequence; identical to SEQ ID NO: 108250
  derived and/or modified sequence opt2 from neuraminidase__InfluenzaA__AEW25324

SEQ ID NO: 112903 - RNA, 1410 nt, Artificial Sequence
  derived and/or modified sequence opt2 from neuraminidase__InfluenzaA__AEW25327
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccccccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacugcgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112904 - RNA, 1410 nt, Artificial Sequence
  derived and/or modified sequence opt2 from neuraminidase__InfluenzaA__AEW25333
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccacaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucugggucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccacugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112905 - RNA, 1410 nt, Artificial Sequence
  derived and/or modified sequence opt2 from neuraminidase__InfluenzaA__AEW25338
augaaccccaaccagaagaucaucaccaucggcuccgucugcauggccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacauccgcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112906 - RNA, 1410 nt, Artificial Sequence
  derived and/or modified sequence opt2 from neuraminidase__InfluenzaA__AEW25343
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuccgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgucugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacuccccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112907 - RNA, 1410 nt, Artificial Sequence
  derived and/or modified sequence opt2 from neuraminidase__InfluenzaA__AEW25351
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccacaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaacgaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaccuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112908 - RNA, 1410 nt, Artificial Sequence
  derived and/or modified sequence opt2 from neuraminidase__InfluenzaA__AEW25358
augaaccccaaccagaagaucaucaccaucggcuccgucugcaugaccaucggcauggccaaccucauccuccagaucggcaacaucaucuccaucugggucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaccuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgucaaguga

SEQ ID NO: 112909 - RNA, 1410 nt, Artificial Sequence; identical to SEQ ID NO: 108250
  derived and/or modified sequence opt2 from neuraminidase__InfluenzaA__AEW25361

SEQ ID NO: 112910 - RNA, 1410 nt, Artificial Sequence
  derived and/or modified sequence opt2 from neuraminidase__InfluenzaA__AEW25379
augaaccccaaccagaagaucaucaccaucggcuccgucugcaugaccaucggcauggccaaccucauccuccagaucggcaacaucaucuccaucuggaccucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgaggucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccgacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112911 - RNA, 1410 nt, Artificial Sequence
  derived and/or modified sequence opt2 from neuraminidase__InfluenzaA__AEW25387
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucgacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucgaggacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112912 - RNA, 1410 nt, Artificial Sequence
  derived and/or modified sequence opt2 from neuraminidase__InfluenzaA__AEW25392
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcacgacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112913 - RNA, 1410 nt, Artificial Sequence
  derived and/or modified sequence opt2 from neuraminidase__InfluenzaA__AEW25397
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgagcccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacuccccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaacgucggcugguccuggcccgacggcgccgagcuccccuucaccaucgacaaguga

SEQ ID NO: 112914 - RNA, 1410 nt, Artificial Sequence; identical to SEQ ID NO: 108250
  derived and/or modified sequence opt2 from neuraminidase__InfluenzaA__AEW25402

SEQ ID NO: 112915 - RNA, 1410 nt, Artificial Sequence; identical to SEQ ID NO: 108250
  derived and/or modified sequence opt2 from neuraminidase__InfluenzaA__AEW25407

SEQ ID NO: 112916 - RNA, 1410 nt, Artificial Sequence
  derived and/or modified sequence opt2 from neuraminidase__InfluenzaA__AEW25418
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccacaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucggcaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgagaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguucuggcccgacggcgccgagcuccccuucaccaucgacaaguga

SEQ ID NO: 112917 - RNA, 1410 nt, Artificial Sequence
  derived and/or modified sequence opt2 from neuraminidase__InfluenzaA__AEW25423
augaaccccaaccagaagaucaucaccaucggcuccgucugcaugaccaucggcauggccaaccucauccuccagaucggcaacaucaucuccaucuggaucuccaacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112918 - RNA, 1410 nt, Artificial Sequence; identical to SEQ ID NO: 108250
  derived and/or modified sequence opt2 from neuraminidase__InfluenzaA__AEW25426

SEQ ID NO: 112919 - RNA, 1410 nt, Artificial Sequence
  derived and/or modified sequence opt2 from neuraminidase__InfluenzaA__AEW25432
augaaccccaaccagaagaucaucaccaucggcuccgucugcaugaccaucggcauggccaaccucauccuccagaucggcaacaucaucuccaucuggaccucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuccuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcaucaacuccgacgccgucggcugguccuggcccgacggcgccgagcuccccuucaccaucgacaaguga

SEQ ID NO: 112920 - RNA, 1410 nt, Artificial Sequence
  derived and/or modified sequence opt2 from neuraminidase__InfluenzaA__AEW25436
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccaucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccgcaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaccaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccaugggcugguccuggcccgacggcgccgagcuccccuucaccaucgacaaguga

SEQ ID NO: 112921 - RNA, 1410 nt, Artificial Sequence; identical to SEQ ID NO: 108250
  derived and/or modified sequence opt2 from neuraminidase__InfluenzaA__AEW25440

SEQ ID NO: 112922 - RNA, 1410 nt, Artificial Sequence
  derived and/or modified sequence opt2 from neuraminidase__InfluenzaA__AEW25448
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaccgacaaguga

SEQ ID NO: 112923 - RNA, 1410 nt, Artificial Sequence; identical to SEQ ID NO: 108250
  derived and/or modified sequence opt2 from neuraminidase__InfluenzaA__AEW25456

SEQ ID NO: 112924 - RNA, 1410 nt, Artificial Sequence
  derived and/or modified sequence opt2 from neuraminidase__InfluenzaA__AEW25464
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagcucaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112925 - RNA, 1410 nt, Artificial Sequence
  derived and/or modified sequence opt2 from neuraminidase__InfluenzaA__AEW25474
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuccaccaucgacaaguga

SEQ ID NO: 112926 - RNA, 1410 nt, Artificial Sequence
  derived and/or modified sequence opt2 from neuraminidase__InfluenzaA__AEW25484
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccuggaucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgaccacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112927 - RNA, 1410 nt, Artificial Sequence
  derived and/or modified sequence opt2 from neuraminidase__InfluenzaA__AEW25494
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacuccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaccuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112928 - RNA, 1410 nt, Artificial Sequence
  derived and/or modified sequence opt2 from neuraminidase__InfluenzaA__AEW25503
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgccuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112929 - RNA, 1410 nt, Artificial Sequence
  derived and/or modified sequence opt2 from neuraminidase__InfluenzaA__AEW25511
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccacaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgucgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112930 - RNA, 1410 nt, Artificial Sequence
  derived and/or modified sequence opt2 from neuraminidase__InfluenzaA__AEW25530
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccacaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcuacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgagaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112931 - RNA, 1410 nt, Artificial Sequence
  derived and/or modified sequence opt2 from neuraminidase__InfluenzaA__AEW25537
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaaccaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112932 - RNA, 1410 nt, Artificial Sequence; identical to SEQ ID NO: 108250
  derived and/or modified sequence opt2 from neuraminidase__InfluenzaA__AEW25547

SEQ ID NO: 112933 - RNA, 1410 nt, Artificial Sequence; identical to SEQ ID NO: 108250
  derived and/or modified sequence opt2 from neuraminidase__InfluenzaA__AEW25556

SEQ ID NO: 112934 - RNA, 1410 nt, Artificial Sequence; identical to SEQ ID NO: 108250
  derived and/or modified sequence opt2 from neuraminidase__InfluenzaA__AEW25566

SEQ ID NO: 112935 - RNA, 1410 nt, Artificial Sequence
  derived and/or modified sequence opt2 from neuraminidase__InfluenzaA__AEW25584
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcagggcaucgucggcaucaacgagugguccggcuacggcggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112936 - RNA, 1410 nt, Artificial Sequence; identical to SEQ ID NO: 108250
  derived and/or modified sequence opt2 from neuraminidase__InfluenzaA__AEW25592

SEQ ID NO: 112937 - RNA, 1410 nt, Artificial Sequence
  derived and/or modified sequence opt2 from neuraminidase__InfluenzaA__AEW25602
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaagaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112938 - RNA, 1410 nt, Artificial Sequence
  derived and/or modified sequence opt2 from neuraminidase__InfluenzaA__AEW25612
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgaccgccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112939 - RNA, 1410 nt, Artificial Sequence
  derived and/or modified sequence opt2 from neuraminidase__InfluenzaA__AEW25622
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacuccaucuggaccuccggcuccuccaucuccuucugcggcgucaacuccgacaccgucggcugguccuggcccgacggcgccgagcuccccuucaccaucgacaaguga

SEQ ID NO: 112940 - RNA, 1410 nt, Artificial Sequence
  derived and/or modified sequence opt2 from neuraminidase__InfluenzaA__AEW25631
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccuccggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112941 - RNA, 1410 nt, Artificial Sequence; identical to SEQ ID NO: 108250
  derived and/or modified sequence opt2 from neuraminidase__InfluenzaA__AEW25639

SEQ ID NO: 112942 - RNA, 1410 nt, Artificial Sequence
  derived and/or modified sequence opt2 from neuraminidase__InfluenzaA__AEW25648
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccacaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112943 - RNA, 1410 nt, Artificial Sequence
  derived and/or modified sequence opt2 from neuraminidase__InfluenzaA__AEW25656
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuuccccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112944 - RNA, 1410 nt, Artificial Sequence
  derived and/or modified sequence opt2 from neuraminidase__InfluenzaA__AEW25664
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucaccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccggcggcugguccuggcccgacggcgccgagcuccccuucaccaucgacaaguga

SEQ ID NO: 112945 - RNA, 1410 nt, Artificial Sequence; identical to SEQ ID NO: 112939
  derived and/or modified sequence opt2 from neuraminidase__InfluenzaA__AEW25671

SEQ ID NO: 112946 - RNA, 1410 nt, Artificial Sequence; identical to SEQ ID NO: 109427
  derived and/or modified sequence opt2 from neuraminidase__InfluenzaA__AEW25680

SEQ ID NO: 112947 - RNA, 1410 nt, Artificial Sequence
  derived and/or modified sequence opt2 from neuraminidase__InfluenzaA__AEW25689
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcgucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 112948 - RNA, 1410 nt, Artificial Sequence; identical to SEQ ID NO: 112942
  derived and/or modified sequence opt2 from neuraminidase__InfluenzaA__AEW25698

SEQ ID NO: 112949 - RNA, 1410 nt, Artificial Sequence; identical to SEQ ID NO: 108250
  derived and/or modified sequence opt2 from neuraminidase__InfluenzaA__AEW25708

SEQ ID NO: 112950 - RNA, 1410 nt, Artificial Sequence; identical to SEQ ID NO: 108250
  derived and/or modified sequence opt2 from neuraminidase__InfluenzaA__AEX09177

SEQ ID NO: 112951 - RNA, 1413 nt, Artificial Sequence
  derived and/or modified sequence opt2 from neuraminidase__InfluenzaA__AEX33324
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112952 - RNA, 1413 nt, Artificial Sequence
  derived and/or modified sequence opt2 from neuraminidase__InfluenzaA__AEX33368
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcgccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112953 - RNA, 1413 nt, Artificial Sequence
  derived and/or modified sequence opt2 from neuraminidase__InfluenzaA__AEX33379
augaaccccaaccagaagaucaucaccaucggcuccaucuccaucgccaucggcaucaucucccucaugcuccagaucggcaacaucaucuccaucugggccucccacuccauccagaccggcauccagaaccacaccggcaucugcaaccagcgcaucaucaccuacgagaacuccaccugggucaaccacaccuacgucaccaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgcccccgcgacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112954 - RNA, 1413 nt, Artificial Sequence; identical to SEQ ID NO: 112953
  derived and/or modified sequence opt2 from neuraminidase__InfluenzaA__AEX33390

SEQ ID NO: 112955 - RNA, 1413 nt, Artificial Sequence; identical to SEQ ID NO: 112953
  derived and/or modified sequence opt2 from neuraminidase__InfluenzaA__AEX33401

SEQ ID NO: 112956 - RNA, 1413 nt, Artificial Sequence; identical to SEQ ID NO: 112953
  derived and/or modified sequence opt2 from neuraminidase__InfluenzaA__AEX33412

SEQ ID NO: 112957 - RNA, 1413 nt, Artificial Sequence; identical to SEQ ID NO: 112953
  derived and/or modified sequence opt2 from neuraminidase__InfluenzaA__AEX33423

SEQ ID NO: 112958 - RNA, 1413 nt, Artificial Sequence; identical to SEQ ID NO: 112953
  derived and/or modified sequence opt2 from neuraminidase__InfluenzaA__AEX33434

SEQ ID NO: 112959 - RNA, 1413 nt, Artificial Sequence; identical to SEQ ID NO: 112953
  derived and/or modified sequence opt2 from neuraminidase__InfluenzaA__AEX33445

SEQ ID NO: 112960 - RNA, 1410 nt, Artificial Sequence
  derived and/or modified sequence opt2 from neuraminidase__InfluenzaA__AEX33544
augaaccccaaccagaagaucaucaccaucggcuccuucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggagaagaccgaggucugguggaccuccaacuccaucgucgucuucugcggcaccuccggcaccuacggcaccggcuccuggcccgacggcgccgacaucaaccucaugcccaucuga

SEQ ID NO: 112961 - RNA, 1410 nt, Artificial Sequence; identical to SEQ ID NO: 106226
  derived and/or modified sequence opt2 from neuraminidase__InfluenzaA__AEX33555

SEQ ID NO: 112962 - RNA, 1410 nt, Artificial Sequence
  derived and/or modified sequence opt2 from neuraminidase__InfluenzaA__AEX33610
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacaacaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112963 - RNA, 1410 nt, Artificial Sequence
  derived and/or modified sequence opt2 from neuraminidase__InfluenzaA__AEX33828
augaaccccaaccagaagaucaucaccaucggcuccgucucccucaccaucuccaccaucugcuucuucaugcagaucgccauccucaucaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112964 - RNA, 1410 nt, Artificial Sequence; identical to SEQ ID NO: 106224
  derived and/or modified sequence opt2 from neuraminidase__InfluenzaA__AEX33839

SEQ ID NO: 112965 - RNA, 1413 nt, Artificial Sequence
  derived and/or modified sequence opt2 from neuraminidase__InfluenzaA__AEX33861
augaaccccaaccagaagaucaucaccaucggcuccaucuccaucgccaucggcaccaucucccucaugcuccaggucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucgcccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggccaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 112966 - RNA, 1410 nt, Artificial Sequence
  derived and/or modified sequence opt2 from neuraminidase__InfluenzaA__AEX33872
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcagugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112967 - RNA, 1410 nt, Artificial Sequence; identical to SEQ ID NO: 106224
  derived and/or modified sequence opt2 from neuraminidase__InfluenzaA__AEX33883

SEQ ID NO: 112968 - RNA, 1410 nt, Artificial Sequence
  derived and/or modified sequence opt2 from neuraminidase__InfluenzaA__AEX33894
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucgacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112969 - RNA, 1413 nt, Artificial Sequence
  derived and/or modified sequence opt2 from neuraminidase__InfluenzaA__AEX33916
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgccgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaccggcuacaucugcuccggcgucuucggcgacaacccccgccccaaggacggcgagggcuccugcaaccccaugaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 112970 - RNA, 1413 nt, Artificial Sequence; identical to SEQ ID NO: 107381
  derived and/or modified sequence opt2 from neuraminidase__InfluenzaA__AEX33927

SEQ ID NO: 112971 - RNA, 1413 nt, Artificial Sequence
  derived and/or modified sequence opt2 from neuraminidase__InfluenzaA__AEX33938
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgucgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccaccaacugguccuggcccgacggcgccgagcuccccuucaccaucgacaaguga

SEQ ID NO: 112972 - RNA, 1413 nt, Artificial Sequence
  derived and/or modified sequence opt2 from neuraminidase__InfluenzaA__AEX33949
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgucgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccgucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 112973 - RNA, 1410 nt, Artificial Sequence
  derived and/or modified sequence opt2 from neuraminidase__InfluenzaA__AEX33971
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaccgucuaccucaccaacaccaccaccgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggcaucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112974 - RNA, 1410 nt, Artificial Sequence
  derived and/or modified sequence opt2 from neuraminidase__InfluenzaA__AEX33993
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 112975 - RNA, 1410 nt, Artificial Sequence; identical to SEQ ID NO: 108024
  derived and/or modified sequence opt2 from neuraminidase__InfluenzaA__AEX34026

SEQ ID NO: 112976 - RNA, 1410 nt, Artificial Sequence
  derived and/or modified sequence opt2 from neuraminidase__InfluenzaA__AEX34036
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112977 - RNA, 1410 nt, Artificial Sequence
  derived and/or modified sequence opt2 from neuraminidase__InfluenzaA__AEX34058
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucaccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112978 - RNA, 1410 nt, Artificial Sequence
  derived and/or modified sequence opt2 from neuraminidase__InfluenzaA__AEX34103
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgacaucaaccucaugcccaucuga

SEQ ID NO: 112979 - RNA, 1410 nt, Artificial Sequence
  derived and/or modified sequence opt2 from neuraminidase__InfluenzaA__AEX34114
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccccaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112980 - RNA, 1410 nt, Artificial Sequence
  derived and/or modified sequence opt2 from neuraminidase__InfluenzaA__AEX34137
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112981 - RNA, 1410 nt, Artificial Sequence
  derived and/or modified sequence opt2 from neuraminidase__InfluenzaA__AEX34191
augaaccccaaccagaagaucaucaccaucggcuccgucucccucuccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112982 - RNA, 1410 nt, Artificial Sequence
  derived and/or modified sequence opt2 from neuraminidase__InfluenzaA__AEX34224
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112983 - RNA, 1410 nt, Artificial Sequence
  derived and/or modified sequence opt2 from neuraminidase__InfluenzaA__AEX34235
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaaguccgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112984 - RNA, 1410 nt, Artificial Sequence
  derived and/or modified sequence opt2 from neuraminidase__InfluenzaA__AEX34246
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccaggucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112985 - RNA, 1410 nt, Artificial Sequence
  derived and/or modified sequence opt2 from neuraminidase__InfluenzaA__AEX34257
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112986 - RNA, 1410 nt, Artificial Sequence
  derived and/or modified sequence opt2 from neuraminidase__InfluenzaA__AEX34268
augaaccccaacaagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112987 - RNA, 1410 nt, Artificial Sequence
  derived and/or modified sequence opt2 from neuraminidase__InfluenzaA__AEX34278
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgagaagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112988 - RNA, 1413 nt, Artificial Sequence
  derived and/or modified sequence opt2 from neuraminidase__InfluenzaA__AEX34310
augaaccccaaccagaagaucaucaccaucggcuccaucuccaucgccaucggcaucaucucccucaugcuccagaucggcaacaucaucuccaucugggccucccacuccauccagaccggcacccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccuccccggcgagaacaccaccaucuggaccuccggcuccuccaucuccuucugcggcgucaacggcgacaucgccaacugguccuggcccgacggcgccgagcuccccuucaccaucgacaaguga

SEQ ID NO: 112989 - RNA, 1413 nt, Artificial Sequence
  derived and/or modified sequence opt2 from neuraminidase__InfluenzaA__AEX34321
augaaccccaaccagaagaucaucaccaucggcuccaucuccaucgccaucggcaucaucucccucaugcuccagaucggcaacaucaucuccaucugggucucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112990 - RNA, 1410 nt, Artificial Sequence; identical to SEQ ID NO: 107569
  derived and/or modified sequence opt2 from neuraminidase__InfluenzaA__AEX34356

SEQ ID NO: 112991 - RNA, 1410 nt, Artificial Sequence
  derived and/or modified sequence opt2 from neuraminidase__InfluenzaA__AEX34367
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgccaagcacgucgaggagugcuccugcuacccccgccaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112992 - RNA, 1410 nt, Artificial Sequence
  derived and/or modified sequence opt2 from neuraminidase__InfluenzaA__AEX34378
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaaccucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgccaagcacgucgaggagugcuccugcuacccccgccaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112993 - RNA, 1410 nt, Artificial Sequence
  derived and/or modified sequence opt2 from neuraminidase__InfluenzaA__AEX34400
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 112994 - RNA, 1413 nt, Artificial Sequence
  derived and/or modified sequence opt2 from neuraminidase__InfluenzaA__AEX34432
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgucgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcaccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 112995 - RNA, 1413 nt, Artificial Sequence; identical to SEQ ID NO: 112994
  derived and/or modified sequence opt2 from neuraminidase__InfluenzaA__AEX34443

SEQ ID NO: 112996 - RNA, 1410 nt, Artificial Sequence; identical to SEQ ID NO: 108115
  derived and/or modified sequence opt2 from neuraminidase__InfluenzaA__AEX34454

SEQ ID NO: 112997 - RNA, 1413 nt, Artificial Sequence
  derived and/or modified sequence opt2 from neuraminidase__InfluenzaA__AEX34465
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaaguccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcaucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcaugcgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 112998 - RNA, 1413 nt, Artificial Sequence; identical to SEQ ID NO: 112951
  derived and/or modified sequence opt2 from neuraminidase__InfluenzaA__AEX34476

SEQ ID NO: 112999 - RNA, 1413 nt, Artificial Sequence; identical to SEQ ID NO: 112953
  derived and/or modified sequence opt2 from neuraminidase__InfluenzaA__AEX34487

SEQ ID NO: 113000 - RNA, 1413 nt, Artificial Sequence; identical to SEQ ID NO: 112953
  derived and/or modified sequence opt2 from neuraminidase__InfluenzaA__AEX34498

SEQ ID NO: 113001 - RNA, 1413 nt, Artificial Sequence; identical to SEQ ID NO: 112953
  derived and/or modified sequence opt2 from neuraminidase__InfluenzaA__AEX34509

SEQ ID NO: 113002 - RNA, 1413 nt, Artificial Sequence; identical to SEQ ID NO: 112953
  derived and/or modified sequence opt2 from neuraminidase__InfluenzaA__AEX34520

SEQ ID NO: 113003 - RNA, 1413 nt, Artificial Sequence; identical to SEQ ID NO: 112953
  derived and/or modified sequence opt2 from neuraminidase__InfluenzaA__AEX34531

SEQ ID NO: 113004 - RNA, 1413 nt, Artificial Sequence; identical to SEQ ID NO: 112953
  derived and/or modified sequence opt2 from neuraminidase__InfluenzaA__AEX34542

SEQ ID NO: 113005 - RNA, 1413 nt, Artificial Sequence; identical to SEQ ID NO: 112953
  derived and/or modified sequence opt2 from neuraminidase__InfluenzaA__AEX34553

SEQ ID NO: 113006 - RNA, 1413 nt, Artificial Sequence; identical to SEQ ID NO: 112953
  derived and/or modified sequence opt2 from neuraminidase__InfluenzaA__AEX34564

SEQ ID NO: 113007 - RNA, 1413 nt, Artificial Sequence; identical to SEQ ID NO: 112953
  derived and/or modified sequence opt2 from neuraminidase__InfluenzaA__AEX34575

SEQ ID NO: 113008 - RNA, 1413 nt, Artificial Sequence; identical to SEQ ID NO: 112953
  derived and/or modified sequence opt2 from neuraminidase__InfluenzaA__AEX34586

SEQ ID NO: 113009 - RNA, 1413 nt, Artificial Sequence; identical to SEQ ID NO: 112953
  derived and/or modified sequence opt2 from neuraminidase__InfluenzaA__AEX34597

SEQ ID NO: 113010 - RNA, 1413 nt, Artificial Sequence; identical to SEQ ID NO: 112953
  derived and/or modified sequence opt2 from neuraminidase__InfluenzaA__AEX34608

SEQ ID NO: 113011 - RNA, 1413 nt, Artificial Sequence; identical to SEQ ID NO: 112953
  derived and/or modified sequence opt2 from neuraminidase__InfluenzaA__AEX34619

SEQ ID NO: 113012 - RNA, 1413 nt, Artificial Sequence; identical to SEQ ID NO: 112953
  derived and/or modified sequence opt2 from neuraminidase__InfluenzaA__AEX34630

SEQ ID NO: 113013 - RNA, 1413 nt, Artificial Sequence; identical to SEQ ID NO: 112953
  derived and/or modified sequence opt2 from neuraminidase__InfluenzaA__AEX34641

SEQ ID NO: 113014 - RNA, 1413 nt, Artificial Sequence
  derived and/or modified sequence opt2 from neuraminidase__InfluenzaA__AEX34653
augaaccccaaccagaagaucaucaccaucggcuccaucuccaucgccaucggcaucaucucccucaugcuccaggucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucgcccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggccucggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggccaggucaccaaguccgucgagcucaacgcccccaacuuccacuacgaggagugcuccugcuaccccgacaccggcaccgucaugugcgucugccgcgacaacuggcacggcuccaaccgccccugggucuccuucaaccaggaccucgacuaccagaucggcuacaucugcuccggcgucuucggcgacaacccccgccccaaggacggcaagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 113015 - RNA, 1413 nt, Artificial Sequence
  derived and/or modified sequence opt2 from neuraminidase__InfluenzaA__AEX34664
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcgucaacggcuccugcuucaccaucaugaccgacggccccuccaacggcgccgccuccuacaagaucuucaagaucgagaagggcaaggucaccaagucccgcgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 113016 - RNA, 1413 nt, Artificial Sequence; identical to SEQ ID NO: 112994
  derived and/or modified sequence opt2 from neuraminidase__InfluenzaA__AEX34686

SEQ ID NO: 113017 - RNA, 1413 nt, Artificial Sequence
  derived and/or modified sequence opt2 from neuraminidase__InfluenzaA__AEX34760
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgucgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgucaacugguccuggcccgacggcgccgagcuccccuucaccaucgacaaguga

SEQ ID NO: 113018 - RNA, 1413 nt, Artificial Sequence
  derived and/or modified sequence opt2 from neuraminidase__InfluenzaA__AEX34771
augaaccccaaccagaagaucaucaccaucggcuccaucuccaucgccaucggcaucaucucccucauccuccagaucggcaacaucaucuccaucugggccucccacuccauccagaccggcucccagaaccacaccggcaucugcaaccagcgcaucaucaccuacgagaacuccaccugggucaacaacaccuacgucaacaucaacaacaccaacgucgucgucgagaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacucccgcuucgaguccgucgccugguccgccuccgccugccacgacggcaugggcuggcucaccaucggcaucuccggccccgacaacggcgccgucgccguccucaaguacaacggcaucaucaccgagaccaucaaguccuggaagaagcgcauccuccgcacccaggaguccgagugcgucugcaugaacggcuccugcuucaccaucaugaccgacggccccuccaacggcgccgccuccuacaagaucuucaagaucgagaagggcaaggucaccaagaccaucgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcgagggcuccugcaaccccgucaccgucgacggcgccgacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccggcaccgccaacugguccuggcccgacggcgccgagcuccccuucaccaucgacaaguga

SEQ ID NO: 113019 - RNA, 1413 nt, Artificial Sequence; identical to SEQ ID NO: 108973
  derived and/or modified sequence opt2 from neuraminidase__InfluenzaA__AEX34782

SEQ ID NO: 113020 - RNA, 1413 nt, Artificial Sequence
  derived and/or modified sequence opt2 from neuraminidase__InfluenzaA__AEX34793
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 113021 - RNA, 1413 nt, Artificial Sequence; identical to SEQ ID NO: 113020
  derived and/or modified sequence opt2 from neuraminidase__InfluenzaA__AEX34804

SEQ ID NO: 113022 - RNA, 1413 nt, Artificial Sequence
  derived and/or modified sequence opt2 from neuraminidase__InfluenzaA__AEX34815
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucaccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113023 - RNA, 1413 nt, Artificial Sequence; identical to SEQ ID NO: 113020
  derived and/or modified sequence opt2 from neuraminidase__InfluenzaA__AEX34826

SEQ ID NO: 113024 - RNA, 1413 nt, Artificial Sequence; identical to SEQ ID NO: 113020
  derived and/or modified sequence opt2 from neuraminidase__InfluenzaA__AEX34837

SEQ ID NO: 113025 - RNA, 1413 nt, Artificial Sequence
  derived and/or modified sequence opt2 from neuraminidase__InfluenzaA__AEX34859
augaaccccaaccagaagaucaucaccaucggcuccaccuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucaucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 113026 - RNA, 1413 nt, Artificial Sequence
  derived and/or modified sequence opt2 from neuraminidase__InfluenzaA__AEX34870
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaucuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113027 - RNA, 1413 nt, Artificial Sequence
  derived and/or modified sequence opt2 from neuraminidase__InfluenzaA__AEX34881
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaaggcccccgucacccucaucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 113028 - RNA, 1413 nt, Artificial Sequence
  derived and/or modified sequence opt2 from neuraminidase__InfluenzaA__AEX34892
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcagaacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113029 - RNA, 1413 nt, Artificial Sequence
  derived and/or modified sequence opt2 from neuraminidase__InfluenzaA__AEX34903
augaaccccaaccagaagaucaucaccaucggcuccaucuccaucgccaucggcaucaucucccucaugcuccagaucggcaacaucaucuccaucugggccucccgcuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucgucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccguccgccaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 113030 - RNA, 1413 nt, Artificial Sequence; identical to SEQ ID NO: 108973
  derived and/or modified sequence opt2 from neuraminidase__InfluenzaA__AEX34914

SEQ ID NO: 113031 - RNA, 1413 nt, Artificial Sequence; identical to SEQ ID NO: 108973
  derived and/or modified sequence opt2 from neuraminidase__InfluenzaA__AEX34925

SEQ ID NO: 113032 - RNA, 1413 nt, Artificial Sequence; identical to SEQ ID NO: 108973
  derived and/or modified sequence opt2 from neuraminidase__InfluenzaA__AEX34936

SEQ ID NO: 113033 - RNA, 1413 nt, Artificial Sequence; identical to SEQ ID NO: 108973
  derived and/or modified sequence opt2 from neuraminidase__InfluenzaA__AEX34947

SEQ ID NO: 113034 - RNA, 1413 nt, Artificial Sequence; identical to SEQ ID NO: 108973
  derived and/or modified sequence opt2 from neuraminidase__InfluenzaA__AEX34958

SEQ ID NO: 113035 - RNA, 1413 nt, Artificial Sequence; identical to SEQ ID NO: 108973
  derived and/or modified sequence opt2 from neuraminidase__InfluenzaA__AEX34969

SEQ ID NO: 113036 - RNA, 1413 nt, Artificial Sequence; identical to SEQ ID NO: 108973
  derived and/or modified sequence opt2 from neuraminidase__InfluenzaA__AEX34980

SEQ ID NO: 113037 - RNA, 1413 nt, Artificial Sequence; identical to SEQ ID NO: 108973
  derived and/or modified sequence opt2 from neuraminidase__InfluenzaA__AEX34991

SEQ ID NO: 113038 - RNA, 1413 nt, Artificial Sequence
  derived and/or modified sequence opt2 from neuraminidase__InfluenzaA__AEX35002
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagacccccgucacccucaucggcaacuccucccucugcuccaucuccggcugggccaucuacaccaaggacaacuccauccgcaucggcuccaagggcgacgucuucgucauccgcgagcccuucaucuccugcucccaccucgagugcaagaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaucggcuggcucaccaucggcaucuccggccccgacaacggcgccgucgccguccucaaguacaagggcaucaucaccggcaccaucaaguccuggaagaagcagauccuccgcacccaggaguccgagugcgucugcaugaacggcuccugcuucaccaucaugaccgacggccccuccaacggcgccgccuccuacaagaucuucaagaucgagaagggcaaggucaccaaguccauggagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggaccgcgagggcuccugcaaccccgucaccgucgacggcgccaacggcgucaagggcuucuccuacaaguacggcaacggcgucuggaucggccgcaccaaguccaaccgcauccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacggcgacaucgccaacugguccuggcccgacggcgccgagcuccccuucaccaucgacaaguga

SEQ ID NO: 113039 - RNA, 1413 nt, Artificial Sequence; identical to SEQ ID NO: 108973
  derived and/or modified sequence opt2 from neuraminidase__InfluenzaA__AEX35013

SEQ ID NO: 113040 - RNA, 1413 nt, Artificial Sequence; identical to SEQ ID NO: 108973
  derived and/or modified sequence opt2 from neuraminidase__InfluenzaA__AEX35024

SEQ ID NO: 113041 - RNA, 1413 nt, Artificial Sequence; identical to SEQ ID NO: 108973
  derived and/or modified sequence opt2 from neuraminidase__InfluenzaA__AEX35035

SEQ ID NO: 113042 - RNA, 1413 nt, Artificial Sequence; identical to SEQ ID NO: 108973
  derived and/or modified sequence opt2 from neuraminidase__InfluenzaA__AEX35046

SEQ ID NO: 113043 - RNA, 1413 nt, Artificial Sequence; identical to SEQ ID NO: 108973
  derived and/or modified sequence opt2 from neuraminidase__InfluenzaA__AEX35057

SEQ ID NO: 113044 - RNA, 1413 nt, Artificial Sequence; identical to SEQ ID NO: 108973
  derived and/or modified sequence opt2 from neuraminidase__InfluenzaA__AEX35068

SEQ ID NO: 113045 - RNA, 1413 nt, Artificial Sequence
  derived and/or modified sequence opt2 from neuraminidase__InfluenzaA__AEX35079
augaaccccaaccagaagaucaucaccaucggcuccaucuccaucgccaucggcaucaucucccucaugcuccagaucggcaacaucaucuccaugugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccaggaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113046 - RNA, 1413 nt, Artificial Sequence; identical to SEQ ID NO: 113020
  derived and/or modified sequence opt2 from neuraminidase__InfluenzaA__AEX35090

SEQ ID NO: 113047 - RNA, 1413 nt, Artificial Sequence
  derived and/or modified sequence opt2 from neuraminidase__InfluenzaA__AEX35101
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuuccacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacgacaacggcgucuggaucggccgcaccaaguccaaccgccuccgcaagggcuucgagaugaucugggaccccaacggcuggaccaacaccgacuccgucuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113048 - RNA, 1413 nt, Artificial Sequence
  derived and/or modified sequence opt2 from neuraminidase__InfluenzaA__AEX35112
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgccuccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113049 - RNA, 1413 nt, Artificial Sequence; identical to SEQ ID NO: 108973
  derived and/or modified sequence opt2 from neuraminidase__InfluenzaA__AEX35123

SEQ ID NO: 113050 - RNA, 1413 nt, Artificial Sequence
  derived and/or modified sequence opt2 from neuraminidase__InfluenzaA__AEX35145
augaaccccaaccagaagaucaucaccaucggcuccaucuccaucgccaucggcaucaucucccucaugcuccagaucggcaacaucaucuccaucugggccucccacuccauccagaccggcucccagaacaacaccggcaucugcaaccagcgcaucaucaccuacgagaacuccaccugggucaaccacaccuacgucaacaucaacaacaccaacgucgucgccggcgaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccggcaccaucaaguccuggaagaagcagauccuccgcacccaggaguccgagugcgucugcaugaacggcuccugcuucaccaucaugaccgacggccccuccaacaaggccgccuccuacaagaucuucaagaucgagaagggcaaggucaccaaguccaucgagcucaacgcccccaacuucuacuacgaggagugcuccugcuaccccgacaccggcaucgucaugugcgucugccgcgacaacuggcacggcuccaaccgccccugggucuccuucaaccagaaccucgacuaccagaucggcuacaucugcuccggcgucuucggcgacaacccccgccccgaggacggcgagggcuccugcaaccccgucaccgucgacggcgccaacggcgucaagggcuucuccuacaaguacggcaacggcgucuggaucggccgcaccaaguccaaccgccuccgcaagggcuucgagaugaucugggaccccaacggcuggaccaacaccgacuccgacuucuccgucaagcaggacaucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucaacuccgacaccgccaacugguccuggcccgacggcgccgagcuccccuucaccaucgacaaguga

SEQ ID NO: 113051 - RNA, 1413 nt, Artificial Sequence; identical to SEQ ID NO: 113020
  derived and/or modified sequence opt2 from neuraminidase__InfluenzaA__AEX35156

SEQ ID NO: 113052 - RNA, 1413 nt, Artificial Sequence; identical to SEQ ID NO: 108973
  derived and/or modified sequence opt2 from neuraminidase__InfluenzaA__AEX35167

SEQ ID NO: 113053 - RNA, 1413 nt, Artificial Sequence
  derived and/or modified sequence opt2 from neuraminidase__InfluenzaA__AEX35178
augaaccccaaccagaagaucaucaccaucggcuccaucuccaucgccaucggcaucaucucccucaugcuccagaucggcaacaucaucuccaucugggccucccacuccauccagaccggcucccagaaccacaccggcaucugcaaccagcgcaucaucaccuacgagaacuccaccugggucaaccacaccuacgucaacaucaacaacaccaacgucgucgccggcaaggacaagaccuccgucacccucgccggcaacuccucccucugcuccaucuccggcugggccaucuacaccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcucccccuaccgcgcccucauguccugcccccucggcgaggcccccucccccuacaacuccaaguucgaguccgucgccugguccgccuccgccugccacgacggcaugggcuggcucaccaucggcaucuccggccccgacaacggcgccgucgccguccucaaguacaacggcaucaucaccgagaccaucaaguccuggaaggagcgcauccuccgcacccaggaguccgagugcgucugcgucaacggcuccugcuucaccaucaugaccgacggccccuccaacggcgccgccuccuacaagaucuucaagaucgagaagggcaaggucaccaagucccgcgagcucaacgcccccaacuuccacuacgaggagugcuccugcuaccccgacaccggcaccgucaugugcgucugccgcgacaacuggcacggcuccaaccgccccugggucuccuucaaccagaaccucgacuaccagaucggcuacaucugcuccggcgucuucggcgacaacccccgccccaaggacggcaagggcuccugcaaccccgucaccgccgacggcgccgacggcgucaagggcuucuccuacaaguacggcaacggcgucuggaucggccgcaccaaguccaaccgccuccgcaagggcuucgagaugaucugggaccccaacggcuggaccgacaccgacuccgacuucuccgucaagcaggacgucgucgccaucaccgacugguccggcuacuccggcuccuucguccagcaccccgagcucaccggccucgacugcauccgccccugcuucugggucgagcucguccgcggccucccccgcgagaacaccaccaucuggaccuccggcuccuccaucuccuucugcggcgucgacuccgacaccgccaacugguccuggcccgacggcgccgagcuccccuucaccaucgacaaguga

SEQ ID NO: 113054 - RNA, 1413 nt, Artificial Sequence; identical to SEQ ID NO: 112994
  derived and/or modified sequence opt2 from neuraminidase__InfluenzaA__AEX35189

SEQ ID NO: 113055 - RNA, 1413 nt, Artificial Sequence; identical to SEQ ID NO: 112994
  derived and/or modified sequence opt2 from neuraminidase__InfluenzaA__AEX35200

SEQ ID NO: 113056 - RNA, 1413 nt, Artificial Sequence; identical to SEQ ID NO: 108973
  derived and/or modified sequence opt2 from neuraminidase__InfluenzaA__AEX35211

SEQ ID NO: 113057 - RNA, 1410 nt, Artificial Sequence
  derived and/or modified sequence opt2 from neuraminidase__InfluenzaA__AEX35222
augaaccccaaccagaagaucaucaccaucggcuccgucucccucaccaucuccaccaucugcuucuucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113058 - RNA, 1413 nt, Artificial Sequence; identical to SEQ ID NO: 112953
  derived and/or modified sequence opt2 from neuraminidase__InfluenzaA__AEX35233

SEQ ID NO: 113059 - RNA, 1410 nt, Artificial Sequence
  derived and/or modified sequence opt2 from neuraminidase__InfluenzaA__AEX35244
augaaccccaaccagaagaucaucaccaucggcuccgucucccucaccaucuccaccaucugcuucuucaugcagaucgccauccucaucaacaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggcaacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacgagguccucuggaccuccaacuccaucgucgucuucugcggcaccuccggcaccuacggcaccggcuccuggcccgacggcgccgacaucaaccucaugcccgucuga

SEQ ID NO: 113060 - RNA, 1410 nt, Artificial Sequence; identical to SEQ ID NO: 107441
  derived and/or modified sequence opt2 from neuraminidase__InfluenzaA__AEX35255

SEQ ID NO: 113061 - RNA, 1413 nt, Artificial Sequence; identical to SEQ ID NO: 112953
  derived and/or modified sequence opt2 from neuraminidase__InfluenzaA__AEX35266

SEQ ID NO: 113062 - RNA, 1413 nt, Artificial Sequence; identical to SEQ ID NO: 112953
  derived and/or modified sequence opt2 from neuraminidase__InfluenzaA__AEX35277

SEQ ID NO: 113063 - RNA, 1410 nt, Artificial Sequence
  derived and/or modified sequence opt2 from neuraminidase__InfluenzaA__AEX35288
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113064 - RNA, 1410 nt, Artificial Sequence; identical to SEQ ID NO: 106226
  derived and/or modified sequence opt2 from neuraminidase__InfluenzaA__AEX35299

SEQ ID NO: 113065 - RNA, 1410 nt, Artificial Sequence
  derived and/or modified sequence opt2 from neuraminidase__InfluenzaA__AEX35310
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaccaggagaccgagguccucuggaccuccaacuccaucgucgucuucugcggcaccuccggcaccuacggcaccggcuccuggcccgacggcgccgacaucaaccucaugcccaucuga

SEQ ID NO: 113066 - RNA, 1410 nt, Artificial Sequence; identical to SEQ ID NO: 106226
  derived and/or modified sequence opt2 from neuraminidase__InfluenzaA__AEX35321

SEQ ID NO: 113067 - RNA, 1410 nt, Artificial Sequence; identical to SEQ ID NO: 107441
  derived and/or modified sequence opt2 from neuraminidase__InfluenzaA__AEX35332

SEQ ID NO: 113068 - RNA, 1410 nt, Artificial Sequence; identical to SEQ ID NO: 107441
  derived and/or modified sequence opt2 from neuraminidase__InfluenzaA__AEX35343

SEQ ID NO: 113069 - RNA, 1410 nt, Artificial Sequence
  derived and/or modified sequence opt2 from neuraminidase__InfluenzaA__AEX35354
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccaccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113070 - RNA, 1410 nt, Artificial Sequence; identical to SEQ ID NO: 106226
  derived and/or modified sequence opt2 from neuraminidase__InfluenzaA__AEX35365

SEQ ID NO: 113071 - RNA, 1410 nt, Artificial Sequence
  derived and/or modified sequence opt2 from neuraminidase__InfluenzaA__AEX35376
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113072 - RNA, 1410 nt, Artificial Sequence; identical to SEQ ID NO: 106226
  derived and/or modified sequence opt2 from neuraminidase__InfluenzaA__AEX35387

SEQ ID NO: 113073 - RNA, 1410 nt, Artificial Sequence
  derived and/or modified sequence opt2 from neuraminidase__InfluenzaA__AEX35398
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113074 - RNA, 1410 nt, Artificial Sequence; identical to SEQ ID NO: 106226
  derived and/or modified sequence opt2 from neuraminidase__InfluenzaA__AEX35409

SEQ ID NO: 113075 - RNA, 1410 nt, Artificial Sequence; identical to SEQ ID NO: 113063
  derived and/or modified sequence opt2 from neuraminidase__InfluenzaA__AEX35420

SEQ ID NO: 113076 - RNA, 1410 nt, Artificial Sequence
  derived and/or modified sequence opt2 from neuraminidase__InfluenzaA__AEX35431
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagaaggagaccgagguccucuggaccuccaacuccaucgucgucuucugcggcaccuccggcaccuacggcaccggcuccuggcccgacggcgccgacaucaaccucaugcccaucuga

SEQ ID NO: 113077 - RNA, 1410 nt, Artificial Sequence; identical to SEQ ID NO: 106224
  derived and/or modified sequence opt2 from neuraminidase__InfluenzaA__AEX35453

SEQ ID NO: 113078 - RNA, 1410 nt, Artificial Sequence; identical to SEQ ID NO: 106224
  derived and/or modified sequence opt2 from neuraminidase__InfluenzaA__AEX35464

SEQ ID NO: 113079 - RNA, 1410 nt, Artificial Sequence; identical to SEQ ID NO: 106224
  derived and/or modified sequence opt2 from neuraminidase__InfluenzaA__AEX35475

SEQ ID NO: 113080 - RNA, 1410 nt, Artificial Sequence; identical to SEQ ID NO: 106224
  derived and/or modified sequence opt2 from neuraminidase__InfluenzaA__AEX35486

SEQ ID NO: 113081 - RNA, 1410 nt, Artificial Sequence
  derived and/or modified sequence opt2 from neuraminidase__InfluenzaA__AEX35497
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113082 - RNA, 1410 nt, Artificial Sequence; identical to SEQ ID NO: 106224
  derived and/or modified sequence opt2 from neuraminidase__InfluenzaA__AEX35508

SEQ ID NO: 113083 - RNA, 1410 nt, Artificial Sequence; identical to SEQ ID NO: 113081
  derived and/or modified sequence opt2 from neuraminidase__InfluenzaA__AEX35519

SEQ ID NO: 113084 - RNA, 1410 nt, Artificial Sequence
  derived and/or modified sequence opt2 from neuraminidase__InfluenzaA__AEX35530
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcagugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaccaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113085 - RNA, 1410 nt, Artificial Sequence; identical to SEQ ID NO: 106224
  derived and/or modified sequence opt2 from neuraminidase__InfluenzaA__AEX35541

SEQ ID NO: 113086 - RNA, 1410 nt, Artificial Sequence
  derived and/or modified sequence opt2 from neuraminidase__InfluenzaA__AEX35552
augaaccccaaccagaagaucaucaccaucggcuccgccucccucaccaucuccaccaucugcuucuucaugcagaucgccauccucaucaccaccgucacccuccacuucaagcaguacgaguucaaccccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgccuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113087 - RNA, 1410 nt, Artificial Sequence
  derived and/or modified sequence opt2 from neuraminidase__InfluenzaA__AEX35563
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgccucggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113088 - RNA, 1410 nt, Artificial Sequence; identical to SEQ ID NO: 112968
  derived and/or modified sequence opt2 from neuraminidase__InfluenzaA__AEX35585

SEQ ID NO: 113089 - RNA, 1410 nt, Artificial Sequence
  derived and/or modified sequence opt2 from neuraminidase__InfluenzaA__AEX35596
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccgacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113090 - RNA, 1410 nt, Artificial Sequence; identical to SEQ ID NO: 106224
  derived and/or modified sequence opt2 from neuraminidase__InfluenzaA__AEX35607

SEQ ID NO: 113091 - RNA, 1410 nt, Artificial Sequence
  derived and/or modified sequence opt2 from neuraminidase__InfluenzaA__AEX35618
augaaccccaaccagaagaucaucaccaucggcuccgucucccucaccaucuccaccaucugcuucuucaugcagaucgccauccucaucaccaccgucacccuccacuucaagcaguacgagcucaacuccccccccaacaaccaggucaugcucugcgagcccaccaucaucgagcgcaacaucaccgagaucgucuaccucaccaacaccaccaucgagaaggagaccugccccaagcucgccgaguaccgcaacugguccaagccccagugcuacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcgacaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113092 - RNA, 1410 nt, Artificial Sequence
  derived and/or modified sequence opt2 from neuraminidase__InfluenzaA__AEX35640
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacaacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaugaaggacuacuccaucgucuccuccuacgucugcuccggccucgucggcgacaccccccgcaagaacgacuccuccuccuccggccacugccucgaccccaacgacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113093 - RNA, 1410 nt, Artificial Sequence
  derived and/or modified sequence opt2 from neuraminidase__InfluenzaA__AEX35651
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgaggacaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113094 - RNA, 1410 nt, Artificial Sequence; identical to SEQ ID NO: 107396
  derived and/or modified sequence opt2 from neuraminidase__InfluenzaA__AEX36105

SEQ ID NO: 113095 - RNA, 1410 nt, Artificial Sequence
  derived and/or modified sequence opt2 from neuraminidase__InfluenzaA__AEX36116
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113096 - RNA, 1410 nt, Artificial Sequence
  derived and/or modified sequence opt2 from neuraminidase__InfluenzaA__AEX36127
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacuggcucaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113097 - RNA, 1410 nt, Artificial Sequence
  derived and/or modified sequence opt2 from neuraminidase__InfluenzaA__AEX36149
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgaggacaaguccugcaucaaccgcugcuucuacgucgagcucauccgcggccgcaaggaggagaccgagguccucuggaccaccaacuccaucgucgucuucugcggcaccuccggcaccuacggcaccggcuccuggcccgacggcgccgacaucaaccucaugcccaucuga

SEQ ID NO: 113098 - RNA, 1410 nt, Artificial Sequence; identical to SEQ ID NO: 108024
  derived and/or modified sequence opt2 from neuraminidase__InfluenzaA__AEX36160

SEQ ID NO: 113099 - RNA, 1410 nt, Artificial Sequence
  derived and/or modified sequence opt2 from neuraminidase__InfluenzaA__AEX36171
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcgacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113100 - RNA, 1410 nt, Artificial Sequence
  derived and/or modified sequence opt2 from neuraminidase__InfluenzaA__AEX36193
augaaccccaaccagaagaucaucaccaucggcuccgucucccucaccaucuccaccaucugcuucuucaugcagaucgccauccucaucaccaccgucacccuccacuucaagcaguacgaguucaacuccucccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaugcucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113101 - RNA, 1410 nt, Artificial Sequence
  derived and/or modified sequence opt2 from neuraminidase__InfluenzaA__AEX36204
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113102 - RNA, 1410 nt, Artificial Sequence
  derived and/or modified sequence opt2 from neuraminidase__InfluenzaA__AEX36215
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagaagaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113103 - RNA, 1410 nt, Artificial Sequence
  derived and/or modified sequence opt2 from neuraminidase__InfluenzaA__AEX36226
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggcaucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113104 - RNA, 1410 nt, Artificial Sequence
  derived and/or modified sequence opt2 from neuraminidase__InfluenzaA__AEX36237
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaagugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggcgcggcuccaaccgccccaucgucgacaucaacaugaaggacuacuccaucgucuccuccuacgucugcuccggccucgucggcgacaccccccgcaagaacgacuccuccuccuccggccacugccucgaccccaacgacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113105 - RNA, 1410 nt, Artificial Sequence
  derived and/or modified sequence opt2 from neuraminidase__InfluenzaA__AEX36248
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggccgcgccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113106 - RNA, 1410 nt, Artificial Sequence; identical to SEQ ID NO: 108024
  derived and/or modified sequence opt2 from neuraminidase__InfluenzaA__AEX36259

SEQ ID NO: 113107 - RNA, 1410 nt, Artificial Sequence
  derived and/or modified sequence opt2 from neuraminidase__InfluenzaA__AEX36270
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcgaggaggagaccaagguccucuggaccuccaacuccaucgucgucuucugcggcaccuccggcaccuacggcaccggcuccuggcccgacggcgccgacaucaaccucaugcccaucuga

SEQ ID NO: 113108 - RNA, 1410 nt, Artificial Sequence
  derived and/or modified sequence opt2 from neuraminidase__InfluenzaA__AEX36281
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113109 - RNA, 1410 nt, Artificial Sequence; identical to SEQ ID NO: 113108
  derived and/or modified sequence opt2 from neuraminidase__InfluenzaA__AEX36292

SEQ ID NO: 113110 - RNA, 1410 nt, Artificial Sequence
  derived and/or modified sequence opt2 from neuraminidase__InfluenzaA__AEX36303
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113111 - RNA, 1410 nt, Artificial Sequence
  derived and/or modified sequence opt2 from neuraminidase__InfluenzaA__AEX36314
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgagaucaaccucaugcccaucuga

SEQ ID NO: 113112 - RNA, 1410 nt, Artificial Sequence; identical to SEQ ID NO: 113108
  derived and/or modified sequence opt2 from neuraminidase__InfluenzaA__AEX36336

SEQ ID NO: 113113 - RNA, 1410 nt, Artificial Sequence
  derived and/or modified sequence opt2 from neuraminidase__InfluenzaA__AEX36347
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaucaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacgccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113114 - RNA, 1410 nt, Artificial Sequence; identical to SEQ ID NO: 107396
  derived and/or modified sequence opt2 from neuraminidase__InfluenzaA__AEX36358

SEQ ID NO: 113115 - RNA, 1410 nt, Artificial Sequence
  derived and/or modified sequence opt2 from neuraminidase__InfluenzaA__AEX36369
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcaccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113116 - RNA, 1410 nt, Artificial Sequence
  derived and/or modified sequence opt2 from neuraminidase__InfluenzaA__AEX36391
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucgccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113117 - RNA, 1410 nt, Artificial Sequence
  derived and/or modified sequence opt2 from neuraminidase__InfluenzaA__AEX36402
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuuccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcaccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113118 - RNA, 1410 nt, Artificial Sequence; identical to SEQ ID NO: 107396
  derived and/or modified sequence opt2 from neuraminidase__InfluenzaA__AEX36413

SEQ ID NO: 113119 - RNA, 1410 nt, Artificial Sequence
  derived and/or modified sequence opt2 from neuraminidase__InfluenzaA__AEX36424
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugcuccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccauccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113120 - RNA, 1410 nt, Artificial Sequence
  derived and/or modified sequence opt2 from neuraminidase__InfluenzaA__AEX36435
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaacuccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113121 - RNA, 1410 nt, Artificial Sequence; identical to SEQ ID NO: 107578
  derived and/or modified sequence opt2 from neuraminidase__InfluenzaA__AEX36446

SEQ ID NO: 113122 - RNA, 1410 nt, Artificial Sequence; identical to SEQ ID NO: 107578
  derived and/or modified sequence opt2 from neuraminidase__InfluenzaA__AEX36457

SEQ ID NO: 113123 - RNA, 1410 nt, Artificial Sequence
  derived and/or modified sequence opt2 from neuraminidase__InfluenzaA__AEX36468
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgacaucaaccucaugcccaucuga

SEQ ID NO: 113124 - RNA, 1410 nt, Artificial Sequence
  derived and/or modified sequence opt2 from neuraminidase__InfluenzaA__AEX36479
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccccaccaacaccaccaccgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113125 - RNA, 1410 nt, Artificial Sequence
  derived and/or modified sequence opt2 from neuraminidase__InfluenzaA__AEX36490
augaaccccaaccagaagaucaucaccaucggcuccgucucccucaccaucuccaccaucugcuucuucaugcagaucgccauccucaucaccaccgucacccuccacuucaagcaguacgaguucuccuacccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcaacgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgacaucaaccucaugcccaucuga

SEQ ID NO: 113126 - RNA, 1410 nt, Artificial Sequence
  derived and/or modified sequence opt2 from neuraminidase__InfluenzaA__AEX36501
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaagugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacggccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaaguccgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113127 - RNA, 1410 nt, Artificial Sequence
  derived and/or modified sequence opt2 from neuraminidase__InfluenzaA__AEX36512
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccgccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113128 - RNA, 1410 nt, Artificial Sequence
  derived and/or modified sequence opt2 from neuraminidase__InfluenzaA__AEX36523
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcgaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113129 - RNA, 1410 nt, Artificial Sequence; identical to SEQ ID NO: 108111
  derived and/or modified sequence opt2 from neuraminidase__InfluenzaA__AEX36534

SEQ ID NO: 113130 - RNA, 1410 nt, Artificial Sequence
  derived and/or modified sequence opt2 from neuraminidase__InfluenzaA__AEX36545
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgcccucggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113131 - RNA, 1410 nt, Artificial Sequence; identical to SEQ ID NO: 108024
  derived and/or modified sequence opt2 from neuraminidase__InfluenzaA__AEX36556

SEQ ID NO: 113132 - RNA, 1410 nt, Artificial Sequence; identical to SEQ ID NO: 108024
  derived and/or modified sequence opt2 from neuraminidase__InfluenzaA__AEX36567

SEQ ID NO: 113133 - RNA, 1410 nt, Artificial Sequence
  derived and/or modified sequence opt2 from neuraminidase__InfluenzaA__AEX36578
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113134 - RNA, 1410 nt, Artificial Sequence; identical to SEQ ID NO: 113133
  derived and/or modified sequence opt2 from neuraminidase__InfluenzaA__AEX36589

SEQ ID NO: 113135 - RNA, 1410 nt, Artificial Sequence
  derived and/or modified sequence opt2 from neuraminidase__InfluenzaA__AEX36600
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacaacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113136 - RNA, 1410 nt, Artificial Sequence; identical to SEQ ID NO: 106226
  derived and/or modified sequence opt2 from neuraminidase__InfluenzaA__AEX36622

SEQ ID NO: 113137 - RNA, 1410 nt, Artificial Sequence
  derived and/or modified sequence opt2 from neuraminidase__InfluenzaA__AEX63619
augaaccccaaccagaagaucaucaccaucggcuccaucugcaugaccaucggcaucgccucccucauccuccagaucggcaacaucaucuccaucuggaucucccacuccauccagaccgagaaccagaaccagcccgagaucugcaaccagaacgucaucaccuacgagaacaacaccugggucaaccagaccuacgucaacgucuccaacaccaacuucgucgccgagcaggccgucgccuccgucaagcucgccggcaacuccucccucugccccgucuccggcugggccaucuacuccaaggacaacuccguccgcaucggcuccaagggcgacgucuucgucauccgcgagcccuucaucuccugcucccacuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaagaacauccuccgcacccaggaguccgagugcgccugcgucaacggcuccugcuucaccgucaugaccgacggccccuccaacggccaggccuccuacaaggucuucaagaucgagcgcggcaaggucgucaaguccgucgagcucaacgcccccaacuaccacuacgaggagugcuccugcuaccccgaguccuccgagaucaccugcgucugccgcgacaacuggcacggcuccaaccgccccugggucuccuucaaccagaaccucgaguaccagaugggcuacaucugcuccggcaucuucggcgacaacccccgccccaacgacaagaccggcuccugcggccccgucuucuccaacggcgccaacggcgucaagggcuucuccuucaaguacggcaacggcgucuggaucggccgcaccaaguccaccuccucccgcaugggcuucgagaugaucugggaccccgacggcuggaccaagaccgacgacaaguucuccgucaagcaggacaucaucggcaucaccgacugguccggcuacuccggcuccuucguccagcaccccgagcucaccggccucgacugcaugcgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113138 - RNA, 1365 nt, Artificial Sequence; identical to SEQ ID NO: 107231
  derived and/or modified sequence opt2 from neuraminidase__InfluenzaA__AEX92876

SEQ ID NO: 113139 - RNA, 1365 nt, Artificial Sequence; identical to SEQ ID NO: 107231
  derived and/or modified sequence opt2 from neuraminidase__InfluenzaA__AEX92887

SEQ ID NO: 113140 - RNA, 1365 nt, Artificial Sequence; identical to SEQ ID NO: 107231
  derived and/or modified sequence opt2 from neuraminidase__InfluenzaA__AEX92904

SEQ ID NO: 113141 - RNA, 1365 nt, Artificial Sequence; identical to SEQ ID NO: 107231
  derived and/or modified sequence opt2 from neuraminidase__InfluenzaA__AEX96924

SEQ ID NO: 113142 - RNA, 1410 nt, Artificial Sequence; identical to SEQ ID NO: 109981
  derived and/or modified sequence opt2 from neuraminidase__InfluenzaA__AEY69091

SEQ ID NO: 113143 - RNA, 1410 nt, Artificial Sequence; identical to SEQ ID NO: 108111
  derived and/or modified sequence opt2 from neuraminidase__InfluenzaA__AEY69101

SEQ ID NO: 113144 - RNA, 1410 nt, Artificial Sequence; identical to SEQ ID NO: 108111
  derived and/or modified sequence opt2 from neuraminidase__InfluenzaA__AEY69112

SEQ ID NO: 113145 - RNA, 1410 nt, Artificial Sequence
  derived and/or modified sequence opt2 from neuraminidase__InfluenzaA__AEY69145
augaacaccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccaccaucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccgucgucgucuucugcggcaccuccggcaccuacggcaccggcuccuggcccgacggcgccgacaucaaccucaugcccaucuga

SEQ ID NO: 113146 - RNA, 1410 nt, Artificial Sequence; identical to SEQ ID NO: 108111
  derived and/or modified sequence opt2 from neuraminidase__InfluenzaA__AEY69156

SEQ ID NO: 113147 - RNA, 1410 nt, Artificial Sequence
  derived and/or modified sequence opt2 from neuraminidase__InfluenzaA__AEY69167
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113148 - RNA, 1410 nt, Artificial Sequence; identical to SEQ ID NO: 113147
  derived and/or modified sequence opt2 from neuraminidase__InfluenzaA__AEY69178

SEQ ID NO: 113149 - RNA, 1410 nt, Artificial Sequence; identical to SEQ ID NO: 113147
  derived and/or modified sequence opt2 from neuraminidase__InfluenzaA__AEY69189

SEQ ID NO: 113150 - RNA, 1410 nt, Artificial Sequence
  derived and/or modified sequence opt2 from neuraminidase__InfluenzaA__AEY69211
augaaccccaaccagaagaucaucaccaucggcuccgucucccucaccaucuccaccaucugcuucuucaugcagaucgccauccucaucaccaccgucacccuccacuucaagcaguacaaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113151 - RNA, 1410 nt, Artificial Sequence; identical to SEQ ID NO: 113147
  derived and/or modified sequence opt2 from neuraminidase__InfluenzaA__AEY69233

SEQ ID NO: 113152 - RNA, 1410 nt, Artificial Sequence; identical to SEQ ID NO: 113147
  derived and/or modified sequence opt2 from neuraminidase__InfluenzaA__AEY69272

SEQ ID NO: 113153 - RNA, 1410 nt, Artificial Sequence; identical to SEQ ID NO: 113147
  derived and/or modified sequence opt2 from neuraminidase__InfluenzaA__AEY69283

SEQ ID NO: 113154 - RNA, 1410 nt, Artificial Sequence
  derived and/or modified sequence opt2 from neuraminidase__InfluenzaA__AEY69294
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggcaacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113155 - RNA, 1410 nt, Artificial Sequence; identical to SEQ ID NO: 113154
  derived and/or modified sequence opt2 from neuraminidase__InfluenzaA__AEY69305

SEQ ID NO: 113156 - RNA, 1410 nt, Artificial Sequence; identical to SEQ ID NO: 113154
  derived and/or modified sequence opt2 from neuraminidase__InfluenzaA__AEY69316

SEQ ID NO: 113157 - RNA, 1410 nt, Artificial Sequence; identical to SEQ ID NO: 113154
  derived and/or modified sequence opt2 from neuraminidase__InfluenzaA__AEY69788

SEQ ID NO: 113158 - RNA, 1410 nt, Artificial Sequence; identical to SEQ ID NO: 108111
  derived and/or modified sequence opt2 from neuraminidase__InfluenzaA__AEY69799

SEQ ID NO: 113159 - RNA, 1410 nt, Artificial Sequence; identical to SEQ ID NO: 108111
  derived and/or modified sequence opt2 from neuraminidase__InfluenzaA__AEY69810

SEQ ID NO: 113160 - RNA, 1410 nt, Artificial Sequence; identical to SEQ ID NO: 113147
  derived and/or modified sequence opt2 from neuraminidase__InfluenzaA__AEY69832

SEQ ID NO: 113161 - RNA, 1410 nt, Artificial Sequence
  derived and/or modified sequence opt2 from neuraminidase__InfluenzaA__AEY69843
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucgccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113162 - RNA, 1410 nt, Artificial Sequence; identical to SEQ ID NO: 113147
  derived and/or modified sequence opt2 from neuraminidase__InfluenzaA__AEY69854

SEQ ID NO: 113163 - RNA, 1410 nt, Artificial Sequence; identical to SEQ ID NO: 113147
  derived and/or modified sequence opt2 from neuraminidase__InfluenzaA__AEY69876

SEQ ID NO: 113164 - RNA, 1410 nt, Artificial Sequence; identical to SEQ ID NO: 113147
  derived and/or modified sequence opt2 from neuraminidase__InfluenzaA__AEY69887

SEQ ID NO: 113165 - RNA, 1410 nt, Artificial Sequence; identical to SEQ ID NO: 113147
  derived and/or modified sequence opt2 from neuraminidase__InfluenzaA__AEY69898

SEQ ID NO: 113166 - RNA, 1410 nt, Artificial Sequence; identical to SEQ ID NO: 108111
  derived and/or modified sequence opt2 from neuraminidase__InfluenzaA__AEY69909

SEQ ID NO: 113167 - RNA, 1410 nt, Artificial Sequence
  derived and/or modified sequence opt2 from neuraminidase__InfluenzaA__AEY69942
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgacggcggcgacaucugggucacccgcgagcccuacgucuccugcgaccccgacaagugcuaccaguucgcccucggccagggcaccacccucaacaacauccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113168 - RNA, 1410 nt, Artificial Sequence; identical to SEQ ID NO: 113167
  derived and/or modified sequence opt2 from neuraminidase__InfluenzaA__AEY69953

SEQ ID NO: 113169 - RNA, 1410 nt, Artificial Sequence; identical to SEQ ID NO: 113167
  derived and/or modified sequence opt2 from neuraminidase__InfluenzaA__AEY69964

SEQ ID NO: 113170 - RNA, 1410 nt, Artificial Sequence; identical to SEQ ID NO: 113147
  derived and/or modified sequence opt2 from neuraminidase__InfluenzaA__AEY69975

SEQ ID NO: 113171 - RNA, 1410 nt, Artificial Sequence; identical to SEQ ID NO: 113147
  derived and/or modified sequence opt2 from neuraminidase__InfluenzaA__AEY69986

SEQ ID NO: 113172 - RNA, 1410 nt, Artificial Sequence; identical to SEQ ID NO: 113147
  derived and/or modified sequence opt2 from neuraminidase__InfluenzaA__AEY69997

SEQ ID NO: 113173 - RNA, 1410 nt, Artificial Sequence; identical to SEQ ID NO: 113147
  derived and/or modified sequence opt2 from neuraminidase__InfluenzaA__AEY70008

SEQ ID NO: 113174 - RNA, 1410 nt, Artificial Sequence; identical to SEQ ID NO: 113147
  derived and/or modified sequence opt2 from neuraminidase__InfluenzaA__AEY70019

SEQ ID NO: 113175 - RNA, 1410 nt, Artificial Sequence; identical to SEQ ID NO: 113147
  derived and/or modified sequence opt2 from neuraminidase__InfluenzaA__AEY70259

SEQ ID NO: 113176 - RNA, 1410 nt, Artificial Sequence; identical to SEQ ID NO: 113147
  derived and/or modified sequence opt2 from neuraminidase__InfluenzaA__AEY70270

SEQ ID NO: 113177 - RNA, 1410 nt, Artificial Sequence; identical to SEQ ID NO: 113147
  derived and/or modified sequence opt2 from neuraminidase__InfluenzaA__AEY70281

SEQ ID NO: 113178 - RNA, 1410 nt, Artificial Sequence; identical to SEQ ID NO: 108111
  derived and/or modified sequence opt2 from neuraminidase__InfluenzaA__AEY70303

SEQ ID NO: 113179 - RNA, 1410 nt, Artificial Sequence; identical to SEQ ID NO: 108111
  derived and/or modified sequence opt2 from neuraminidase__InfluenzaA__AEY70314

SEQ ID NO: 113180 - RNA, 1410 nt, Artificial Sequence
  derived and/or modified sequence opt2 from neuraminidase__InfluenzaA__AEY70325
augaaccccaaccagaagaucaucaccaucggcuccgucucccucaccaucuccaccaucugcuucuucaugcagaucgccauccucaugaccaccgucacccuccacuucaagcaguacgaguucaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113181 - RNA, 1410 nt, Artificial Sequence
  derived and/or modified sequence opt2 from neuraminidase__InfluenzaA__AEY70336
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcaucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgaggacaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113182 - RNA, 1410 nt, Artificial Sequence; identical to SEQ ID NO: 108250
  derived and/or modified sequence opt2 from neuraminidase__InfluenzaA__AEY70358

SEQ ID NO: 113183 - RNA, 1410 nt, Artificial Sequence; identical to SEQ ID NO: 108111
  derived and/or modified sequence opt2 from neuraminidase__InfluenzaA__AEY70379

SEQ ID NO: 113184 - RNA, 1410 nt, Artificial Sequence; identical to SEQ ID NO: 109873
  derived and/or modified sequence opt2 from neuraminidase__InfluenzaA__AFB70139

SEQ ID NO: 113185 - RNA, 1410 nt, Artificial Sequence; identical to SEQ ID NO: 108250
  derived and/or modified sequence opt2 from neuraminidase__InfluenzaA__AFB70141

SEQ ID NO: 113186 - RNA, 1410 nt, Artificial Sequence; identical to SEQ ID NO: 109873
  derived and/or modified sequence opt2 from neuraminidase__InfluenzaA__AFB70147

SEQ ID NO: 113187 - RNA, 1410 nt, Artificial Sequence; identical to SEQ ID NO: 108250
  derived and/or modified sequence opt2 from neuraminidase__InfluenzaA__AFB70153

SEQ ID NO: 113188 - RNA, 1410 nt, Artificial Sequence; identical to SEQ ID NO: 108250
  derived and/or modified sequence opt2 from neuraminidase__InfluenzaA__AFB70155

SEQ ID NO: 113189 - RNA, 1410 nt, Artificial Sequence; identical to SEQ ID NO: 109220
  derived and/or modified sequence opt2 from neuraminidase__InfluenzaA__AFB70157

SEQ ID NO: 113190 - RNA, 1410 nt, Artificial Sequence; identical to SEQ ID NO: 108250
  derived and/or modified sequence opt2 from neuraminidase__InfluenzaA__AFB70159

SEQ ID NO: 113191 - RNA, 1410 nt, Artificial Sequence
  derived and/or modified sequence opt2 from neuraminidase__InfluenzaA__AFB70161
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaccaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguacuggcccgacggcgccgagcuccccuucaccaucgacaaguga

SEQ ID NO: 113192 - RNA, 1410 nt, Artificial Sequence
  derived and/or modified sequence opt2 from neuraminidase__InfluenzaA__AFB70163
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacgccaucuggaccuccggcuccuccaucuccuucugcggcgucaacuccgacaccgucggcugguccuggcccgacggcgccgagcuccccuucaccaucgacaaguga

SEQ ID NO: 113193 - RNA, 1410 nt, Artificial Sequence
  derived and/or modified sequence opt2 from neuraminidase__InfluenzaA__AFB70169
augaaccccaaccagaagaucaucaccaucggcuccgucugcaugaccaucggcauggccaaccucauccuccagaucggcaacaucaucuccaucuggaucaaccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113194 - RNA, 1410 nt, Artificial Sequence; identical to SEQ ID NO: 108250
  derived and/or modified sequence opt2 from neuraminidase__InfluenzaA__AFB70199

SEQ ID NO: 113195 - RNA, 1410 nt, Artificial Sequence; identical to SEQ ID NO: 108250
  derived and/or modified sequence opt2 from neuraminidase__InfluenzaA__AFB70209

SEQ ID NO: 113196 - RNA, 1410 nt, Artificial Sequence; identical to SEQ ID NO: 108250
  derived and/or modified sequence opt2 from neuraminidase__InfluenzaA__AFB70219

SEQ ID NO: 113197 - RNA, 1410 nt, Artificial Sequence; identical to SEQ ID NO: 108250
  derived and/or modified sequence opt2 from neuraminidase__InfluenzaA__AFB70229

SEQ ID NO: 113198 - RNA, 1410 nt, Artificial Sequence; identical to SEQ ID NO: 108250
  derived and/or modified sequence opt2 from neuraminidase__InfluenzaA__AFB70239

SEQ ID NO: 113199 - RNA, 1410 nt, Artificial Sequence; identical to SEQ ID NO: 108250
  derived and/or modified sequence opt2 from neuraminidase__InfluenzaA__AFB70249

SEQ ID NO: 113200 - RNA, 1410 nt, Artificial Sequence; identical to SEQ ID NO: 108250
  derived and/or modified sequence opt2 from neuraminidase__InfluenzaA__AFB70259

SEQ ID NO: 113201 - RNA, 1410 nt, Artificial Sequence; identical to SEQ ID NO: 109220
  derived and/or modified sequence opt2 from neuraminidase__InfluenzaA__AFB70269

SEQ ID NO: 113202 - RNA, 1410 nt, Artificial Sequence; identical to SEQ ID NO: 108250
  derived and/or modified sequence opt2 from neuraminidase__InfluenzaA__AFB70279

SEQ ID NO: 113203 - RNA, 1410 nt, Artificial Sequence; identical to SEQ ID NO: 108250
  derived and/or modified sequence opt2 from neuraminidase__InfluenzaA__AFB70289

SEQ ID NO: 113204 - RNA, 1410 nt, Artificial Sequence; identical to SEQ ID NO: 108250
  derived and/or modified sequence opt2 from neuraminidase__InfluenzaA__AFB70299

SEQ ID NO: 113205 - RNA, 1410 nt, Artificial Sequence; identical to SEQ ID NO: 108250
  derived and/or modified sequence opt2 from neuraminidase__InfluenzaA__AFB70309

SEQ ID NO: 113206 - RNA, 1410 nt, Artificial Sequence; identical to SEQ ID NO: 109873
  derived and/or modified sequence opt2 from neuraminidase__InfluenzaA__AFB70319

SEQ ID NO: 113207 - RNA, 1410 nt, Artificial Sequence; identical to SEQ ID NO: 108250
  derived and/or modified sequence opt2 from neuraminidase__InfluenzaA__AFB70329

SEQ ID NO: 113208 - RNA, 1410 nt, Artificial Sequence; identical to SEQ ID NO: 108250
  derived and/or modified sequence opt2 from neuraminidase__InfluenzaA__AFB70349

SEQ ID NO: 113209 - RNA, 1410 nt, Artificial Sequence; identical to SEQ ID NO: 108250
  derived and/or modified sequence opt2 from neuraminidase__InfluenzaA__AFB70359

SEQ ID NO: 113210 - RNA, 1410 nt, Artificial Sequence; identical to SEQ ID NO: 108250
  derived and/or modified sequence opt2 from neuraminidase__InfluenzaA__AFB70369

SEQ ID NO: 113211 - RNA, 1410 nt, Artificial Sequence; identical to SEQ ID NO: 108250
  derived and/or modified sequence opt2 from neuraminidase__InfluenzaA__AFB70379

SEQ ID NO: 113212 - RNA, 1410 nt, Artificial Sequence; identical to SEQ ID NO: 108250
  derived and/or modified sequence opt2 from neuraminidase__InfluenzaA__AFB70389

SEQ ID NO: 113213 - RNA, 1410 nt, Artificial Sequence; identical to SEQ ID NO: 108250
  derived and/or modified sequence opt2 from neuraminidase__InfluenzaA__AFB70399

SEQ ID NO: 113214 - RNA, 1410 nt, Artificial Sequence; identical to SEQ ID NO: 108250
  derived and/or modified sequence opt2 from neuraminidase__InfluenzaA__AFB70409

SEQ ID NO: 113215 - RNA, 1410 nt, Artificial Sequence
  derived and/or modified sequence opt2 from neuraminidase__InfluenzaA__AFB77614
augcaccccaaccaggaggucaucuccaucgucuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguucuggcccgacggcgccgagcuccccuucaccaucgacaaguga

SEQ ID NO: 113216 - RNA, 1410 nt, Artificial Sequence
  derived and/or modified sequence opt2 from neuraminidase__InfluenzaA__AFB77615
augcaccccaaccaggagaucaucaccuucgucuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113217 - RNA, 1410 nt, Artificial Sequence
  derived and/or modified sequence opt2 from neuraminidase__InfluenzaA__AFB78128
augaaccccaaccagaagaucaucaccaucggcuccgucucccucaccaucgccaccaucugcuuccucaugcagaucgucauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaccuccaagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaagcccaacuccaagcuccagaucaaccgccaggucaucgucgagcgcggcaacauguccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113218 - RNA, 1410 nt, Artificial Sequence
  derived and/or modified sequence opt2 from neuraminidase__InfluenzaA__AFC62078
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcucuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacgacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcauggacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113219 - RNA, 1410 nt, Artificial Sequence
  derived and/or modified sequence opt2 from neuraminidase__InfluenzaA__AFC62079
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucaucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcauccucggcgacaacccccgccccaacgacaagaccggcuccugcggccccgucuccuccaacggcgccaacggcgucaagggcuucuccuucaaguacggcaacggcgucugggucggccgcaccaaguccaucuccucccgcaacggcuucgagaugaucugggaccccaacggcuggaccggcaccgacaacaacuucuccaucaagcaggacaucgucggcaucaaggagugguccggcuacuccggcuccuucguccagcaccccgagcucaccggccucgacugcauccgccccugcuucugggucgagcucauccgcggccgccccaaggagaacaccaucuggaccuccggcuccaucaucuccuucugcggcgucaacuccgacaccgucggcugguccuggcccgacggcgccgagcuccccuucaccaucgacaaguga

SEQ ID NO: 113220 - RNA, 1410 nt, Artificial Sequence
  derived and/or modified sequence opt2 from neuraminidase__InfluenzaA__AFC62080
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuacuacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggcaugggcugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113221 - RNA, 1410 nt, Artificial Sequence
  derived and/or modified sequence opt2 from neuraminidase__InfluenzaA__AFC62082
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacgacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggcuccaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113222 - RNA, 1410 nt, Artificial Sequence; identical to SEQ ID NO: 105737
  derived and/or modified sequence opt2 from neuraminidase__InfluenzaA__AFD63529

SEQ ID NO: 113223 - RNA, 1410 nt, Artificial Sequence; identical to SEQ ID NO: 105737
  derived and/or modified sequence opt2 from neuraminidase__InfluenzaA__AFD63540

SEQ ID NO: 113224 - RNA, 1410 nt, Artificial Sequence
  derived and/or modified sequence opt2 from neuraminidase__InfluenzaA__AFD63551
augaaccccaaccagaagaucaucaccaucggcuccgucucccucaccaucgccgccaucugcuuccucaugcagaucgccauccucgucaccaccgucacccuccacuucaagcagcacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacggccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113225 - RNA, 1410 nt, Artificial Sequence; identical to SEQ ID NO: 105737
  derived and/or modified sequence opt2 from neuraminidase__InfluenzaA__AFD63562

SEQ ID NO: 113226 - RNA, 1410 nt, Artificial Sequence
  derived and/or modified sequence opt2 from neuraminidase__InfluenzaA__AFD63573
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucggccgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113227 - RNA, 1410 nt, Artificial Sequence
  derived and/or modified sequence opt2 from neuraminidase__InfluenzaA__AFD63584
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgagcgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113228 - RNA, 1410 nt, Artificial Sequence
  derived and/or modified sequence opt2 from neuraminidase__InfluenzaA__AFD63595
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugcaaggacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113229 - RNA, 1410 nt, Artificial Sequence; identical to SEQ ID NO: 105737
  derived and/or modified sequence opt2 from neuraminidase__InfluenzaA__AFD63606

SEQ ID NO: 113230 - RNA, 1410 nt, Artificial Sequence; identical to SEQ ID NO: 105657
  derived and/or modified sequence opt2 from neuraminidase__InfluenzaA__AFD63628

SEQ ID NO: 113231 - RNA, 1410 nt, Artificial Sequence; identical to SEQ ID NO: 105737
  derived and/or modified sequence opt2 from neuraminidase__InfluenzaA__AFD63639

SEQ ID NO: 113232 - RNA, 1410 nt, Artificial Sequence; identical to SEQ ID NO: 105737
  derived and/or modified sequence opt2 from neuraminidase__InfluenzaA__AFD63650

SEQ ID NO: 113233 - RNA, 1410 nt, Artificial Sequence
  derived and/or modified sequence opt2 from neuraminidase__InfluenzaA__AFD63661
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacuccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113234 - RNA, 1410 nt, Artificial Sequence; identical to SEQ ID NO: 107443
  derived and/or modified sequence opt2 from neuraminidase__InfluenzaA__AFD63672

SEQ ID NO: 113235 - RNA, 1410 nt, Artificial Sequence
  derived and/or modified sequence opt2 from neuraminidase__InfluenzaA__AFD63683
augaaccccaaccagaagaucaucaccaugggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacggccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113236 - RNA, 1410 nt, Artificial Sequence
  derived and/or modified sequence opt2 from neuraminidase__InfluenzaA__AFD63694
augaaccccaaccagaagaucaucaccaucggcuccgucucccucaccaucgccaccaucugcuuccucaugcagaucgccauccucgucaccaccaucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113237 - RNA, 1410 nt, Artificial Sequence
  derived and/or modified sequence opt2 from neuraminidase__InfluenzaA__AFD63705
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggcaagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113238 - RNA, 1410 nt, Artificial Sequence
  derived and/or modified sequence opt2 from neuraminidase__InfluenzaA__AFD63716
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugccaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113239 - RNA, 1410 nt, Artificial Sequence; identical to SEQ ID NO: 105737
  derived and/or modified sequence opt2 from neuraminidase__InfluenzaA__AFD63727

SEQ ID NO: 113240 - RNA, 1410 nt, Artificial Sequence; identical to SEQ ID NO: 105737
  derived and/or modified sequence opt2 from neuraminidase__InfluenzaA__AFD63738

SEQ ID NO: 113241 - RNA, 1410 nt, Artificial Sequence
  derived and/or modified sequence opt2 from neuraminidase__InfluenzaA__AFD63749
augaaccccaaccagaagaucaucaccaucuccuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113242 - RNA, 1410 nt, Artificial Sequence
  derived and/or modified sequence opt2 from neuraminidase__InfluenzaA__AFD63760
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113243 - RNA, 1410 nt, Artificial Sequence; identical to SEQ ID NO: 105737
  derived and/or modified sequence opt2 from neuraminidase__InfluenzaA__AFD63771

SEQ ID NO: 113244 - RNA, 1410 nt, Artificial Sequence; identical to SEQ ID NO: 105737
  derived and/or modified sequence opt2 from neuraminidase__InfluenzaA__AFD63782

SEQ ID NO: 113245 - RNA, 1410 nt, Artificial Sequence; identical to SEQ ID NO: 113242
  derived and/or modified sequence opt2 from neuraminidase__InfluenzaA__AFD63793

SEQ ID NO: 113246 - RNA, 1410 nt, Artificial Sequence; identical to SEQ ID NO: 105737
  derived and/or modified sequence opt2 from neuraminidase__InfluenzaA__AFD63804

SEQ ID NO: 113247 - RNA, 1410 nt, Artificial Sequence; identical to SEQ ID NO: 105737
  derived and/or modified sequence opt2 from neuraminidase__InfluenzaA__AFD63815

SEQ ID NO: 113248 - RNA, 1410 nt, Artificial Sequence; identical to SEQ ID NO: 105737
  derived and/or modified sequence opt2 from neuraminidase__InfluenzaA__AFD63826

SEQ ID NO: 113249 - RNA, 1410 nt, Artificial Sequence; identical to SEQ ID NO: 113242
  derived and/or modified sequence opt2 from neuraminidase__InfluenzaA__AFD63837

SEQ ID NO: 113250 - RNA, 1410 nt, Artificial Sequence
  derived and/or modified sequence opt2 from neuraminidase__InfluenzaA__AFD63848
augaaccccaaccagaagaucaucaccaucggcuccgucucccucaccaucgccgccaucugcuuccucaugcagaucgccauccucgucaccaccgucacccuccacuucaagcagcgcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggagaagaccgaggucugguggaccuccaacuccaucgucgucuucugcggcaccuccggcaccuacggcaccggcuccuggcccgacggcgccgacaucaaccucaugcccaucuga

SEQ ID NO: 113251 - RNA, 1410 nt, Artificial Sequence; identical to SEQ ID NO: 105657
  derived and/or modified sequence opt2 from neuraminidase__InfluenzaA__AFD63859

SEQ ID NO: 113252 - RNA, 1410 nt, Artificial Sequence; identical to SEQ ID NO: 105657
  derived and/or modified sequence opt2 from neuraminidase__InfluenzaA__AFD63870

SEQ ID NO: 113253 - RNA, 1410 nt, Artificial Sequence; identical to SEQ ID NO: 105737
  derived and/or modified sequence opt2 from neuraminidase__InfluenzaA__AFD63881

SEQ ID NO: 113254 - RNA, 1410 nt, Artificial Sequence; identical to SEQ ID NO: 105737
  derived and/or modified sequence opt2 from neuraminidase__InfluenzaA__AFD63892

SEQ ID NO: 113255 - RNA, 1410 nt, Artificial Sequence
  derived and/or modified sequence opt2 from neuraminidase__InfluenzaA__AFD63903
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccggcaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113256 - RNA, 1410 nt, Artificial Sequence
  derived and/or modified sequence opt2 from neuraminidase__InfluenzaA__AFD63914
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggagaagaccgaggucugguggaccuccaacuccaucgucgucuucugcggcaccuccggcaccuacggcaccggcuccuggcccgacggcgccgacaucaaccucaugcccaucuga

SEQ ID NO: 113257 - RNA, 1410 nt, Artificial Sequence; identical to SEQ ID NO: 113242
  derived and/or modified sequence opt2 from neuraminidase__InfluenzaA__AFD63925

SEQ ID NO: 113258 - RNA, 1410 nt, Artificial Sequence
  derived and/or modified sequence opt2 from neuraminidase__InfluenzaA__AFD63936
augaaccccaaccagaagaucaucaccaucggcuccgucucccucaccaucgccaccaucugcuuccucaugcagaucgccauccucgucaccaccgucacccuccacuucaagcagcacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113259 - RNA, 1410 nt, Artificial Sequence; identical to SEQ ID NO: 105737
  derived and/or modified sequence opt2 from neuraminidase__InfluenzaA__AFD63947

SEQ ID NO: 113260 - RNA, 1410 nt, Artificial Sequence; identical to SEQ ID NO: 105737
  derived and/or modified sequence opt2 from neuraminidase__InfluenzaA__AFD63958

SEQ ID NO: 113261 - RNA, 1410 nt, Artificial Sequence; identical to SEQ ID NO: 105737
  derived and/or modified sequence opt2 from neuraminidase__InfluenzaA__AFD63969

SEQ ID NO: 113262 - RNA, 1410 nt, Artificial Sequence; identical to SEQ ID NO: 105737
  derived and/or modified sequence opt2 from neuraminidase__InfluenzaA__AFD63980

SEQ ID NO: 113263 - RNA, 1410 nt, Artificial Sequence
  derived and/or modified sequence opt2 from neuraminidase__InfluenzaA__AFD64002
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaccgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113264 - RNA, 1410 nt, Artificial Sequence; identical to SEQ ID NO: 105647
  derived and/or modified sequence opt2 from neuraminidase__InfluenzaA__AFD64013

SEQ ID NO: 113265 - RNA, 1410 nt, Artificial Sequence
  derived and/or modified sequence opt2 from neuraminidase__InfluenzaA__AFD64024
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagaagaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113266 - RNA, 1410 nt, Artificial Sequence
  derived and/or modified sequence opt2 from neuraminidase__InfluenzaA__AFD64035
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccgucgucgucuucugcggcaccuccggcaccuacggcaccggcuccuggcccgacggcgccgacaucaaccucaugcccaucuga

SEQ ID NO: 113267 - RNA, 1410 nt, Artificial Sequence
  derived and/or modified sequence opt2 from neuraminidase__InfluenzaA__AFD64046
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgagcgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113268 - RNA, 1410 nt, Artificial Sequence; identical to SEQ ID NO: 113242
  derived and/or modified sequence opt2 from neuraminidase__InfluenzaA__AFD64057

SEQ ID NO: 113269 - RNA, 1410 nt, Artificial Sequence
  derived and/or modified sequence opt2 from neuraminidase__InfluenzaA__AFD64068
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacaaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113270 - RNA, 1410 nt, Artificial Sequence
  derived and/or modified sequence opt2 from neuraminidase__InfluenzaA__AFD64079
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgcaucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113271 - RNA, 1410 nt, Artificial Sequence; identical to SEQ ID NO: 105737
  derived and/or modified sequence opt2 from neuraminidase__InfluenzaA__AFD64090

SEQ ID NO: 113272 - RNA, 1410 nt, Artificial Sequence
  derived and/or modified sequence opt2 from neuraminidase__InfluenzaA__AFD64101
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacggccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113273 - RNA, 1410 nt, Artificial Sequence
  derived and/or modified sequence opt2 from neuraminidase__InfluenzaA__AFD64112
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcgacaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113274 - RNA, 1410 nt, Artificial Sequence; identical to SEQ ID NO: 107443
  derived and/or modified sequence opt2 from neuraminidase__InfluenzaA__AFD64123

SEQ ID NO: 113275 - RNA, 1410 nt, Artificial Sequence; identical to SEQ ID NO: 105737
  derived and/or modified sequence opt2 from neuraminidase__InfluenzaA__AFD64134

SEQ ID NO: 113276 - RNA, 1410 nt, Artificial Sequence; identical to SEQ ID NO: 105737
  derived and/or modified sequence opt2 from neuraminidase__InfluenzaA__AFD64145

SEQ ID NO: 113277 - RNA, 1410 nt, Artificial Sequence; identical to SEQ ID NO: 105737
  derived and/or modified sequence opt2 from neuraminidase__InfluenzaA__AFD64156

SEQ ID NO: 113278 - RNA, 1410 nt, Artificial Sequence; identical to SEQ ID NO: 105657
  derived and/or modified sequence opt2 from neuraminidase__InfluenzaA__AFD64167

SEQ ID NO: 113279 - RNA, 1410 nt, Artificial Sequence; identical to SEQ ID NO: 105737
  derived and/or modified sequence opt2 from neuraminidase__InfluenzaA__AFD64181

SEQ ID NO: 113280 - RNA, 1410 nt, Artificial Sequence
  derived and/or modified sequence opt2 from neuraminidase__InfluenzaA__AFD64192
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacgucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113281 - RNA, 1410 nt, Artificial Sequence
  derived and/or modified sequence opt2 from neuraminidase__InfluenzaA__AFD64203
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcacccucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113282 - RNA, 1410 nt, Artificial Sequence; identical to SEQ ID NO: 113242
  derived and/or modified sequence opt2 from neuraminidase__InfluenzaA__AFD64214

SEQ ID NO: 113283 - RNA, 1410 nt, Artificial Sequence; identical to SEQ ID NO: 107441
  derived and/or modified sequence opt2 from neuraminidase__InfluenzaA__AFD64225

SEQ ID NO: 113284 - RNA, 1410 nt, Artificial Sequence; identical to SEQ ID NO: 105737
  derived and/or modified sequence opt2 from neuraminidase__InfluenzaA__AFD64317

SEQ ID NO: 113285 - RNA, 1410 nt, Artificial Sequence; identical to SEQ ID NO: 107443
  derived and/or modified sequence opt2 from neuraminidase__InfluenzaA__AFD64328

SEQ ID NO: 113286 - RNA, 1410 nt, Artificial Sequence; identical to SEQ ID NO: 113242
  derived and/or modified sequence opt2 from neuraminidase__InfluenzaA__AFD64339

SEQ ID NO: 113287 - RNA, 1410 nt, Artificial Sequence; identical to SEQ ID NO: 105737
  derived and/or modified sequence opt2 from neuraminidase__InfluenzaA__AFD64350

SEQ ID NO: 113288 - RNA, 1410 nt, Artificial Sequence; identical to SEQ ID NO: 113242
  derived and/or modified sequence opt2 from neuraminidase__InfluenzaA__AFD64361

SEQ ID NO: 113289 - RNA, 1410 nt, Artificial Sequence; identical to SEQ ID NO: 113242
  derived and/or modified sequence opt2 from neuraminidase__InfluenzaA__AFD64372

SEQ ID NO: 113290 - RNA, 1410 nt, Artificial Sequence; identical to SEQ ID NO: 105737
  derived and/or modified sequence opt2 from neuraminidase__InfluenzaA__AFD64383

SEQ ID NO: 113291 - RNA, 1410 nt, Artificial Sequence; identical to SEQ ID NO: 113242
  derived and/or modified sequence opt2 from neuraminidase__InfluenzaA__AFD64394

SEQ ID NO: 113292 - RNA, 1410 nt, Artificial Sequence; identical to SEQ ID NO: 105737
  derived and/or modified sequence opt2 from neuraminidase__InfluenzaA__AFD64405

SEQ ID NO: 113293 - RNA, 1410 nt, Artificial Sequence; identical to SEQ ID NO: 105737
  derived and/or modified sequence opt2 from neuraminidase__InfluenzaA__AFD64416

SEQ ID NO: 113294 - RNA, 1410 nt, Artificial Sequence; identical to SEQ ID NO: 105737
  derived and/or modified sequence opt2 from neuraminidase__InfluenzaA__AFD64427

SEQ ID NO: 113295 - RNA, 1410 nt, Artificial Sequence
  derived and/or modified sequence opt2 from neuraminidase__InfluenzaA__AFD64438
augaaccccaaccagaagaucaucaccaucggcuccgucucccucaccaucgccgccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaaccucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113296 - RNA, 1410 nt, Artificial Sequence; identical to SEQ ID NO: 105737
  derived and/or modified sequence opt2 from neuraminidase__InfluenzaA__AFD64449

SEQ ID NO: 113297 - RNA, 1410 nt, Artificial Sequence; identical to SEQ ID NO: 105657
  derived and/or modified sequence opt2 from neuraminidase__InfluenzaA__AFD64460

SEQ ID NO: 113298 - RNA, 1410 nt, Artificial Sequence; identical to SEQ ID NO: 112655
  derived and/or modified sequence opt2 from neuraminidase__InfluenzaA__AFD98098

SEQ ID NO: 113299 - RNA, 1410 nt, Artificial Sequence
  derived and/or modified sequence opt2 from neuraminidase__InfluenzaA__AFD98120
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113300 - RNA, 1410 nt, Artificial Sequence; identical to SEQ ID NO: 111030
  derived and/or modified sequence opt2 from neuraminidase__InfluenzaA__AFD98131

SEQ ID NO: 113301 - RNA, 1410 nt, Artificial Sequence; identical to SEQ ID NO: 112655
  derived and/or modified sequence opt2 from neuraminidase__InfluenzaA__AFD98142

SEQ ID NO: 113302 - RNA, 1410 nt, Artificial Sequence; identical to SEQ ID NO: 113299
  derived and/or modified sequence opt2 from neuraminidase__InfluenzaA__AFD98164

SEQ ID NO: 113303 - RNA, 1410 nt, Artificial Sequence
  derived and/or modified sequence opt2 from neuraminidase__InfluenzaA__AFD98175
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113304 - RNA, 1410 nt, Artificial Sequence
  derived and/or modified sequence opt2 from neuraminidase__InfluenzaA__AFD98186
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucgucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucaucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113305 - RNA, 1410 nt, Artificial Sequence; identical to SEQ ID NO: 111030
  derived and/or modified sequence opt2 from neuraminidase__InfluenzaA__AFD98197

SEQ ID NO: 113306 - RNA, 1410 nt, Artificial Sequence; identical to SEQ ID NO: 111767
  derived and/or modified sequence opt2 from neuraminidase__InfluenzaA__AFD98208

SEQ ID NO: 113307 - RNA, 1410 nt, Artificial Sequence
  derived and/or modified sequence opt2 from neuraminidase__InfluenzaA__AFD98218
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucgacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuccugcggcaccuccggcaccuacggcaccggcuccuggcccgacggcgccgaccucaaccucaugcccaucuga

SEQ ID NO: 113308 - RNA, 1410 nt, Artificial Sequence; identical to SEQ ID NO: 111030
  derived and/or modified sequence opt2 from neuraminidase__InfluenzaA__AFD98229

SEQ ID NO: 113309 - RNA, 1410 nt, Artificial Sequence; identical to SEQ ID NO: 111030
  derived and/or modified sequence opt2 from neuraminidase__InfluenzaA__AFD98240

SEQ ID NO: 113310 - RNA, 1410 nt, Artificial Sequence; identical to SEQ ID NO: 113299
  derived and/or modified sequence opt2 from neuraminidase__InfluenzaA__AFD98251

SEQ ID NO: 113311 - RNA, 1410 nt, Artificial Sequence; identical to SEQ ID NO: 113299
  derived and/or modified sequence opt2 from neuraminidase__InfluenzaA__AFD98262

SEQ ID NO: 113312 - RNA, 1410 nt, Artificial Sequence; identical to SEQ ID NO: 112221
  derived and/or modified sequence opt2 from neuraminidase__InfluenzaA__AFD98273

SEQ ID NO: 113313 - RNA, 1410 nt, Artificial Sequence; identical to SEQ ID NO: 111769
  derived and/or modified sequence opt2 from neuraminidase__InfluenzaA__AFD98283

SEQ ID NO: 113314 - RNA, 1410 nt, Artificial Sequence; identical to SEQ ID NO: 111030
  derived and/or modified sequence opt2 from neuraminidase__InfluenzaA__AFD98293

SEQ ID NO: 113315 - RNA, 1410 nt, Artificial Sequence; identical to SEQ ID NO: 112221
  derived and/or modified sequence opt2 from neuraminidase__InfluenzaA__AFD98313

SEQ ID NO: 113316 - RNA, 1410 nt, Artificial Sequence; identical to SEQ ID NO: 111769
  derived and/or modified sequence opt2 from neuraminidase__InfluenzaA__AFD98323

SEQ ID NO: 113317 - RNA, 1410 nt, Artificial Sequence; identical to SEQ ID NO: 112221
  derived and/or modified sequence opt2 from neuraminidase__InfluenzaA__AFD98333

SEQ ID NO: 113318 - RNA, 1410 nt, Artificial Sequence; identical to SEQ ID NO: 113299
  derived and/or modified sequence opt2 from neuraminidase__InfluenzaA__AFD98343

SEQ ID NO: 113319 - RNA, 1410 nt, Artificial Sequence
  derived and/or modified sequence opt2 from neuraminidase__InfluenzaA__AFD98354
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcaacgccuccggcaaggccgacaccaagauccucuucaucgaggagggcaagaucguccacaccuccacccuccucggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113320 - RNA, 1410 nt, Artificial Sequence
  derived and/or modified sequence opt2 from neuraminidase__InfluenzaA__AFD98365
augaaccccaaccagaagaucaucaccaucggcuccgucucccucaccaucuccaccaucugcuucuucaugcagaucgccauccucaucaccaccgucacccuccacuucaagcaguacgaguucuacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccaagguccucuggaccuccaacuccaucgucgucuucugcggcaccuccggcaccuacggcaccggcuccuggcccgacggcgccgaccucaaccucaugcccaucuga

SEQ ID NO: 113321 - RNA, 1410 nt, Artificial Sequence
  derived and/or modified sequence opt2 from neuraminidase__InfluenzaA__AFD98376
augaaccccaaccagaagaucaucaccaucggcuccgucucccucaccaucuccaccaucugcuucuucaugcagaucgccauccucaucaccaccgucacccuccacuucaagcaguacgaguucaacuucccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113322 - RNA, 1410 nt, Artificial Sequence
  derived and/or modified sequence opt2 from neuraminidase__InfluenzaA__AFD98387
augaaccccaaccagaagaucaucaccaucggcuccgucucccucaccaucuccaccaucugcuuccucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcgacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgaccgcuccuccaacucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113323 - RNA, 1410 nt, Artificial Sequence
  derived and/or modified sequence opt2 from neuraminidase__InfluenzaA__AFD98398
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcacccgccaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113324 - RNA, 1410 nt, Artificial Sequence
  derived and/or modified sequence opt2 from neuraminidase__InfluenzaA__AFD98409
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccggccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgacaagggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113325 - RNA, 1410 nt, Artificial Sequence; identical to SEQ ID NO: 113299
  derived and/or modified sequence opt2 from neuraminidase__InfluenzaA__AFD98420

SEQ ID NO: 113326 - RNA, 1410 nt, Artificial Sequence
  derived and/or modified sequence opt2 from neuraminidase__InfluenzaA__AFD98431
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucggccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113327 - RNA, 1410 nt, Artificial Sequence
  derived and/or modified sequence opt2 from neuraminidase__InfluenzaA__AFD98442
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccggcgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucgccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113328 - RNA, 1410 nt, Artificial Sequence
  derived and/or modified sequence opt2 from neuraminidase__InfluenzaA__AFD98452
augaaccccaaccagaagaucaucacccucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113329 - RNA, 1410 nt, Artificial Sequence; identical to SEQ ID NO: 113299
  derived and/or modified sequence opt2 from neuraminidase__InfluenzaA__AFD98463

SEQ ID NO: 113330 - RNA, 1410 nt, Artificial Sequence
  derived and/or modified sequence opt2 from neuraminidase__InfluenzaA__AFD98474
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucaucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113331 - RNA, 1410 nt, Artificial Sequence
  derived and/or modified sequence opt2 from neuraminidase__InfluenzaA__AFD98484
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaugaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113332 - RNA, 1410 nt, Artificial Sequence
  derived and/or modified sequence opt2 from neuraminidase__InfluenzaA__AFD98495
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccaacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113333 - RNA, 1410 nt, Artificial Sequence; identical to SEQ ID NO: 113299
  derived and/or modified sequence opt2 from neuraminidase__InfluenzaA__AFD98506

SEQ ID NO: 113334 - RNA, 1410 nt, Artificial Sequence
  derived and/or modified sequence opt2 from neuraminidase__InfluenzaA__AFD98517
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucaaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113335 - RNA, 1410 nt, Artificial Sequence; identical to SEQ ID NO: 111030
  derived and/or modified sequence opt2 from neuraminidase__InfluenzaA__AFD98528

SEQ ID NO: 113336 - RNA, 1410 nt, Artificial Sequence; identical to SEQ ID NO: 113299
  derived and/or modified sequence opt2 from neuraminidase__InfluenzaA__AFD98539

SEQ ID NO: 113337 - RNA, 1410 nt, Artificial Sequence; identical to SEQ ID NO: 113299
  derived and/or modified sequence opt2 from neuraminidase__InfluenzaA__AFD98550

SEQ ID NO: 113338 - RNA, 1410 nt, Artificial Sequence
  derived and/or modified sequence opt2 from neuraminidase__InfluenzaA__AFD98561
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcgccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaaguccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113339 - RNA, 1410 nt, Artificial Sequence
  derived and/or modified sequence opt2 from neuraminidase__InfluenzaA__AFD98572
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccacccucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113340 - RNA, 1410 nt, Artificial Sequence
  derived and/or modified sequence opt2 from neuraminidase__InfluenzaA__AFD98583
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucucccgcgacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaaguccgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113341 - RNA, 1410 nt, Artificial Sequence
  derived and/or modified sequence opt2 from neuraminidase__InfluenzaA__AFE02944
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucaacugcauccgccccugcuucugggucgagcucauccgcggccgccccaaggagaacaccgucuggaccuccggcuccuccaucuccuucugcggcgucaacuccgacaccgucggcugguccuggcccgacggcgccgagcuccccuucaccaucgacaaguga

SEQ ID NO: 113342 - RNA, 1410 nt, Artificial Sequence
  derived and/or modified sequence opt2 from neuraminidase__InfluenzaA__AFE47627
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113343 - RNA, 1410 nt, Artificial Sequence; identical to SEQ ID NO: 112655
  derived and/or modified sequence opt2 from neuraminidase__InfluenzaA__AFF18509

SEQ ID NO: 113344 - RNA, 1410 nt, Artificial Sequence
  derived and/or modified sequence opt2 from neuraminidase__InfluenzaA__AFF57129
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaacggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113345 - RNA, 1410 nt, Artificial Sequence
  derived and/or modified sequence opt2 from neuraminidase__InfluenzaA__AFF57133
augaaccccaaccagaagaucaucaccaucggcuccgucugcaugaccaucggcauggccaaccucauccuccagaucggcaacaucaucuccaucuggaucucccacuccauccagcucggcaaccagucccagaucgagaccugcaaccaguccgucaucaccuacgagaacaacaccuggcucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcucccccuccgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113346 - RNA, 1410 nt, Artificial Sequence; identical to SEQ ID NO: 108405
  derived and/or modified sequence opt2 from neuraminidase__InfluenzaA__AFF57137

SEQ ID NO: 113347 - RNA, 1410 nt, Artificial Sequence; identical to SEQ ID NO: 108405
  derived and/or modified sequence opt2 from neuraminidase__InfluenzaA__AFF57141

SEQ ID NO: 113348 - RNA, 1410 nt, Artificial Sequence; identical to SEQ ID NO: 108405
  derived and/or modified sequence opt2 from neuraminidase__InfluenzaA__AFF57145

SEQ ID NO: 113349 - RNA, 1410 nt, Artificial Sequence; identical to SEQ ID NO: 108405
  derived and/or modified sequence opt2 from neuraminidase__InfluenzaA__AFF57149

SEQ ID NO: 113350 - RNA, 1410 nt, Artificial Sequence; identical to SEQ ID NO: 108405
  derived and/or modified sequence opt2 from neuraminidase__InfluenzaA__AFF57153

SEQ ID NO: 113351 - RNA, 1410 nt, Artificial Sequence; identical to SEQ ID NO: 108405
  derived and/or modified sequence opt2 from neuraminidase__InfluenzaA__AFF57157

SEQ ID NO: 113352 - RNA, 1410 nt, Artificial Sequence; identical to SEQ ID NO: 108405
  derived and/or modified sequence opt2 from neuraminidase__InfluenzaA__AFF57161

SEQ ID NO: 113353 - RNA, 1410 nt, Artificial Sequence; identical to SEQ ID NO: 108405
  derived and/or modified sequence opt2 from neuraminidase__InfluenzaA__AFF57165

SEQ ID NO: 113354 - RNA, 1410 nt, Artificial Sequence; identical to SEQ ID NO: 108405
  derived and/or modified sequence opt2 from neuraminidase__InfluenzaA__AFF57169

SEQ ID NO: 113355 - RNA, 1410 nt, Artificial Sequence; identical to SEQ ID NO: 108405
  derived and/or modified sequence opt2 from neuraminidase__InfluenzaA__AFF57173

SEQ ID NO: 113356 - RNA, 1410 nt, Artificial Sequence; identical to SEQ ID NO: 108405
  derived and/or modified sequence opt2 from neuraminidase__InfluenzaA__AFF57177

SEQ ID NO: 113357 - RNA, 1410 nt, Artificial Sequence; identical to SEQ ID NO: 108405
  derived and/or modified sequence opt2 from neuraminidase__InfluenzaA__AFF57181

SEQ ID NO: 113358 - RNA, 1410 nt, Artificial Sequence; identical to SEQ ID NO: 108405
  derived and/or modified sequence opt2 from neuraminidase__InfluenzaA__AFF57185

SEQ ID NO: 113359 - RNA, 1410 nt, Artificial Sequence; identical to SEQ ID NO: 108405
  derived and/or modified sequence opt2 from neuraminidase__InfluenzaA__AFF57189

SEQ ID NO: 113360 - RNA, 1350 nt, Artificial Sequence
  derived and/or modified sequence opt2 from neuraminidase__InfluenzaA__AFF60789
augaaccccaacaagaagaucaucaccaucggcuccaucugcauggucaccggcauggucucccucaugcuccagaucggcaaccucaucuccaucugggucucccacuccauccacaccggcaaccagcacaaggccgagcccaucuccaacaccaacuuccucaccgagaaggccgucgccuccgucaagcucgccggcaacuccucccucugccccaucaacggcugggccgucuacuccaaggacaacuccauccgcaucggcuccaagggcgacgucuucgucauccgcgagcccuucaucuccugcucccaccucgagugccgcaccuucuuccucacccagggcgcccuccucaacgacaagcacuccaacggcaccgucaaggaccgcuccccccaccgcacccucauguccugccccgucggcgaggcccccucccccuacaacucccgcuucgaguccgucgccugguccgccuccgccugccacgacggcaccuccuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccucccacaagaucuucaagauggagaagggcaaggucgucaaguccgucgagcucgacgcccccaacuaccacuacgaggagugcuccugcuaccccgacgccggcgagaucaccugcgucugccgcgacaacuggcacggcuccaaccgccccugggucuccuucaaccagaaccucgaguaccagaucggcuacaucugcuccggcgucuucggcgacaacccccgccccaacgacggcaccggcuccugcggccccgucuccuccaacggcgccuacggcgucaagggcuucuccuucaaguacggcaacggcgucuggaucggccgcaccaaguccaccaacucccgcuccggcuucgagaugaucugggaccccaacggcuggaccgagaccgacuccuccuucuccgucaagcaggacaucgucgccaucaccgacugguccggcuacuccggcuccuucguccagcaccccgagcucaccggccucgacugcauccgccccugcuucugggucgagcucauccgcggccgccccaaggaguccaccaucuggaccuccggcuccuccaucuccuucugcggcgucaccuccgacaccgucggcugguccuggcccgacggcgccgagcuccccuucaccaucgacaaguga

SEQ ID NO: 113361 - RNA, 1410 nt, Artificial Sequence
  derived and/or modified sequence opt2 from neuraminidase__InfluenzaA__AFG29043
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccauccgcgaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113362 - RNA, 1410 nt, Artificial Sequence; identical to SEQ ID NO: 110031
  derived and/or modified sequence opt2 from neuraminidase__InfluenzaA__AFG29045

SEQ ID NO: 113363 - RNA, 1410 nt, Artificial Sequence; identical to SEQ ID NO: 110163
  derived and/or modified sequence opt2 from neuraminidase__InfluenzaA__AFG31063

SEQ ID NO: 113364 - RNA, 1410 nt, Artificial Sequence; identical to SEQ ID NO: 108250
  derived and/or modified sequence opt2 from neuraminidase__InfluenzaA__AFG31073

SEQ ID NO: 113365 - RNA, 1410 nt, Artificial Sequence
  derived and/or modified sequence opt2 from neuraminidase__InfluenzaA__AFG31083
augaaccccaaccagaagaucaucaccaucggcuccgucugcaugaccaucggcauggccaaccucauccuccagaucggcaacaucaucuccaucuggaucucccacuccauccagcucgucaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccguccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccaacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113366 - RNA, 1410 nt, Artificial Sequence; identical to SEQ ID NO: 108250
  derived and/or modified sequence opt2 from neuraminidase__InfluenzaA__AFG31093

SEQ ID NO: 113367 - RNA, 1410 nt, Artificial Sequence; identical to SEQ ID NO: 108250
  derived and/or modified sequence opt2 from neuraminidase__InfluenzaA__AFG31103

SEQ ID NO: 113368 - RNA, 1410 nt, Artificial Sequence; identical to SEQ ID NO: 108250
  derived and/or modified sequence opt2 from neuraminidase__InfluenzaA__AFG31113

SEQ ID NO: 113369 - RNA, 1410 nt, Artificial Sequence; identical to SEQ ID NO: 108250
  derived and/or modified sequence opt2 from neuraminidase__InfluenzaA__AFG31123

SEQ ID NO: 113370 - RNA, 1410 nt, Artificial Sequence; identical to SEQ ID NO: 108250
  derived and/or modified sequence opt2 from neuraminidase__InfluenzaA__AFG31133

SEQ ID NO: 113371 - RNA, 1410 nt, Artificial Sequence; identical to SEQ ID NO: 108250
  derived and/or modified sequence opt2 from neuraminidase__InfluenzaA__AFG31143

SEQ ID NO: 113372 - RNA, 1410 nt, Artificial Sequence; identical to SEQ ID NO: 108250
  derived and/or modified sequence opt2 from neuraminidase__InfluenzaA__AFG31153

SEQ ID NO: 113373 - RNA, 1410 nt, Artificial Sequence; identical to SEQ ID NO: 108250
  derived and/or modified sequence opt2 from neuraminidase__InfluenzaA__AFG31163

SEQ ID NO: 113374 - RNA, 1410 nt, Artificial Sequence
  derived and/or modified sequence opt2 from neuraminidase__InfluenzaA__AFG31173
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccuccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113375 - RNA, 1410 nt, Artificial Sequence; identical to SEQ ID NO: 113374
  derived and/or modified sequence opt2 from neuraminidase__InfluenzaA__AFG31183

SEQ ID NO: 113376 - RNA, 1410 nt, Artificial Sequence; identical to SEQ ID NO: 108250
  derived and/or modified sequence opt2 from neuraminidase__InfluenzaA__AFG31193

SEQ ID NO: 113377 - RNA, 1410 nt, Artificial Sequence; identical to SEQ ID NO: 108250
  derived and/or modified sequence opt2 from neuraminidase__InfluenzaA__AFG31203

SEQ ID NO: 113378 - RNA, 1410 nt, Artificial Sequence; identical to SEQ ID NO: 108250
  derived and/or modified sequence opt2 from neuraminidase__InfluenzaA__AFG31213

SEQ ID NO: 113379 - RNA, 1410 nt, Artificial Sequence; identical to SEQ ID NO: 108250
  derived and/or modified sequence opt2 from neuraminidase__InfluenzaA__AFG31223

SEQ ID NO: 113380 - RNA, 1410 nt, Artificial Sequence; identical to SEQ ID NO: 108250
  derived and/or modified sequence opt2 from neuraminidase__InfluenzaA__AFG31233

SEQ ID NO: 113381 - RNA, 1410 nt, Artificial Sequence
  derived and/or modified sequence opt2 from neuraminidase__InfluenzaA__AFG31243
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgucgccggccaguccgucgucuccgucaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccgucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaacggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga

SEQ ID NO: 113382 - RNA, 1410 nt, Artificial Sequence; identical to SEQ ID NO: 111242
  derived and/or modified sequence opt2 from neuraminidase__InfluenzaA__AFG31253

SEQ ID NO: 113383 - RNA, 1410 nt, Artificial Sequence; identical to SEQ ID NO: 108250
  derived and/or modified sequence opt2 from neuraminidase__InfluenzaA__AFG31263

SEQ ID NO: 113384 - RNA, 1410 nt, Artificial Sequence; identical to SEQ ID NO: 108250
  derived and/or modified sequence opt2 from neuraminidase__InfluenzaA__AFG31273

SEQ ID NO: 113385 - RNA, 1410 nt, Artificial Sequence; identical to SEQ ID NO: 108250
  derived and/or modified sequence opt2 from neuraminidase__InfluenzaA__AFG31283

SEQ ID NO: 113386 - RNA, 1410 nt, Artificial Sequence; identical to SEQ ID NO: 108250
  derived and/or modified sequence opt2 from neuraminidase__InfluenzaA__AFG31293

SEQ ID NO: 113387 - RNA, 1410 nt, Artificial Sequence; identical to SEQ ID NO: 108250
  derived and/or modified sequence opt2 from neuraminidase__InfluenzaA__AFG31303

SEQ ID NO: 113388 - RNA, 1410 nt, Artificial Sequence; identical to SEQ ID NO: 108250
  derived and/or modified sequence opt2 from neuraminidase__InfluenzaA__AFG31313

SEQ ID NO: 113389 - RNA, 1410 nt, Artificial Sequence; identical to SEQ ID NO: 108250
  derived and/or modified sequence opt2 from neuraminidase__InfluenzaA__AFG31326

SEQ ID NO: 113390 - RNA, 1410 nt, Artificial Sequence; identical to SEQ ID NO: 108250
  derived and/or modified sequence opt2 from neuraminidase__InfluenzaA__AFG31336

SEQ ID NO: 113391 - RNA, 1410 nt, Artificial Sequence; identical to SEQ ID NO: 111242
  derived and/or modified sequence opt2 from neuraminidase__InfluenzaA__AFG31346

SEQ ID NO: 113392 - RNA, 1410 nt, Artificial Sequence; identical to SEQ ID NO: 111242
  derived and/or modified sequence opt2 from neuraminidase__InfluenzaA__AFG31356

SEQ ID NO: 113393 - RNA, 1410 nt, Artificial Sequence; identical to SEQ ID NO: 111242
  derived and/or modified sequence opt2 from neuraminidase__InfluenzaA__AFG31366

SEQ ID NO: 113394 - RNA, 1410 nt, Artificial Sequence; identical to SEQ ID NO: 111242
  derived and/or modified sequence opt2 from neuraminidase__InfluenzaA__AFG31379

SEQ ID NO: 113395 - RNA, 1410 nt, Artificial Sequence; identical to SEQ ID NO: 111242
  derived and/or modified sequence opt2 from neuraminidase__InfluenzaA__AFG31389

SEQ ID NO: 113396 - RNA, 1410 nt, Artificial Sequence; identical to SEQ ID NO: 111242
  derived and/or modified sequence opt2 from neuraminidase__InfluenzaA__AFG31399

SEQ ID NO: 113397 - RNA, 1410 nt, Artificial Sequence; identical to SEQ ID NO: 111242
  derived and/or modified sequence opt2 from neuraminidase__InfluenzaA__AFG31409

SEQ ID NO: 113398 - RNA, 1410 nt, Artificial Sequence; identical to SEQ ID NO: 108250
  derived and/or modified sequence opt2 from neuraminidase__InfluenzaA__AFG31419

SEQ ID NO: 113399 - RNA, 1410 nt, Artificial Sequence; identical to SEQ ID NO: 108250
  derived and/or modified sequence opt2 from neuraminidase__InfluenzaA__AFG31429

SEQ ID NO: 113400 - RNA, 1410 nt, Artificial Sequence; identical to SEQ ID NO: 108250
  derived and/or modified sequence opt2 from neuraminidase__InfluenzaA__AFG31439

SEQ ID NO: 113401 - RNA, 1410 nt, Artificial Sequence; identical to SEQ ID NO: 108250
  derived and/or modified sequence opt2 from neuraminidase__InfluenzaA__AFG31449

SEQ ID NO: 113402 - RNA, 1410 nt, Artificial Sequence; identical to SEQ ID NO: 108250
  derived and/or modified sequence opt2 from neuraminidase__InfluenzaA__AFG31459

SEQ ID NO: 113403 - RNA, 1410 nt, Artificial Sequence; identical to SEQ ID NO: 108250
  derived and/or modified sequence opt2 from neuraminidase__InfluenzaA__AFG31469

SEQ ID NO: 113404 - RNA, 1410 nt, Artificial Sequence; identical to SEQ ID NO: 108250
  derived and/or modified sequence opt2 from neuraminidase__InfluenzaA__AFG31479

SEQ ID NO: 113405 - RNA, 1410 nt, Artificial Sequence; identical to SEQ ID NO: 108250
  derived and/or modified sequence opt2 from neuraminidase__InfluenzaA__AFG31499

SEQ ID NO: 113406 - RNA, 1410 nt, Artificial Sequence; identical to SEQ ID NO: 110141
  derived and/or modified sequence opt2 from neuraminidase__InfluenzaA__AFG31509

SEQ ID NO: 113407 - RNA, 1410 nt, Artificial Sequence; identical to SEQ ID NO: 111242
  derived and/or modified sequence opt2 from neuraminidase__InfluenzaA__AFG31519

SEQ ID NO: 113408 - RNA, 1410 nt, Artificial Sequence; identical to SEQ ID NO: 108250
  derived and/or modified sequence opt2 from neuraminidase__InfluenzaA__AFG31529

SEQ ID NO: 113409 - RNA, 1410 nt, Artificial Sequence; identical to SEQ ID NO: 110141
  derived and/or modified sequence opt2 from neuraminidase__InfluenzaA__AFG31539

SEQ ID NO: 113410 - RNA, 1410 nt, Artificial Sequence; identical to SEQ ID NO: 108250
  derived and/or modified sequence opt2 from neuraminidase__InfluenzaA__AFG31549

SEQ ID NO: 113411 - RNA, 1410 nt, Artificial Sequence; identical to SEQ ID NO: 108250
  derived and/or modified sequence opt2 from neuraminidase__InfluenzaA__AFG31559

SEQ ID NO: 113412 - RNA, 1410 nt, Artificial Sequence; identical to SEQ ID NO: 111242
  derived and/or modified sequence opt2 from neuraminidase__InfluenzaA__AFG31569

SEQ ID NO: 113413 - RNA, 1410 nt, Artificial Sequence; identical to SEQ ID NO: 108250
  derived and/or modified sequence opt2 from neuraminidase__InfluenzaA__AFG31579

SEQ ID NO: 113414 - RNA, 1410 nt, Artificial Sequence; identical to SEQ ID NO: 108250
  derived and/or modified sequence opt2 from neuraminidase__InfluenzaA__AFG31589

SEQ ID NO: 113415 - RNA, 1410 nt, Artificial Sequence; identical to SEQ ID NO: 108250
  derived and/or modified sequence opt2 from neuraminidase__InfluenzaA__AFG31599

SEQ ID NO: 113416 - RNA, 1410 nt, Artificial Sequence; identical to SEQ ID NO: 108250
  derived and/or modified sequence opt2 from neuraminidase__InfluenzaA__AFG31609

SEQ ID NO: 113417 - RNA, 1410 nt, Artificial Sequence; identical to SEQ ID NO: 108250
  derived and/or modified sequence opt2 from neuraminidase__InfluenzaA__AFG31619

SEQ ID NO: 113418 - RNA, 1410 nt, Artificial Sequence; identical to SEQ ID NO: 108250
  derived and/or modified sequence opt2 from neuraminidase__InfluenzaA__AFG31629

SEQ ID NO: 113419 - RNA, 1410 nt, Artificial Sequence; identical to SEQ ID NO: 111242
  derived and/or modified sequence opt2 from neuraminidase__InfluenzaA__AFG31639

SEQ ID NO: 113420 - RNA, 1410 nt, Artificial Sequence; identical to SEQ ID NO: 108250
  derived and/or modified sequence opt2 from neuraminidase__InfluenzaA__AFG31649

SEQ ID NO: 113421 - RNA, 1410 nt, Artificial Sequence; identical to SEQ ID NO: 108250
  derived and/or modified sequence opt2 from neuraminidase__InfluenzaA__AFG31659

SEQ ID NO: 113422 - RNA, 1410 nt, Artificial Sequence; identical to SEQ ID NO: 108250
  derived and/or modified sequence opt2 from neuraminidase__InfluenzaA__AFG31669

SEQ ID NO: 113423 - RNA, 1410 nt, Artificial Sequence; identical to SEQ ID NO: 105607
  derived and/or modified sequence opt2 from neuraminidase__InfluenzaA__AFG71868

SEQ ID NO: 113424 - RNA, 1410 nt, Artificial Sequence; identical to SEQ ID NO: 105607
  derived and/or modified sequence opt2 from neuraminidase__InfluenzaA__AFG71890

SEQ ID NO: 113425 - RNA, 1410 nt, Artificial Sequence; identical to SEQ ID NO: 105607
  derived and/or modified sequence opt2 from neuraminidase__InfluenzaA__AFG71901

SEQ ID NO: 113426 - RNA, 1410 nt, Artificial Sequence; identical to SEQ ID NO: 105626
  derived and/or modified sequence opt2 from neuraminidase__InfluenzaA__AFG71912

SEQ ID NO: 113427 - RNA, 1410 nt, Artificial Sequence
  derived and/or modified sequence opt2 from neuraminidase__InfluenzaA__AFG71934
augaaccccaaccagaagaucaucaccaucggcuccgucucccucaccaucgccaccgucugcuuccucaugcagaucgccauccucaucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacucccgcuacgucugcuccggccucgucggcgacaccccccgcaacaacgaccgcuucuccaacuccaacugccgcaaccccaacaacgagcgcggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113428 - RNA, 1410 nt, Artificial Sequence
  derived and/or modified sequence opt2 from neuraminidase__InfluenzaA__AFG71945
augaaccccaaccagaagaucaucaccaucggcuccgucucccucaccaucgccaccgucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacucccgcuacgucugcuccggccucgucggcgacaccccccgcaacaacgacaaguccuccaacuccaacugccgcaaccccaacaacgacaagggcaaccacggcgucaagggcugggccuucgacgacggcaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagaccaaggucugguggaccuccaacuccaucgucgucuucugcggcaccuccggcaccuacggcaccggcuccuggcccgacggcgccgacaucaaccucauguccaucuga

SEQ ID NO: 113429 - RNA, 1410 nt, Artificial Sequence; identical to SEQ ID NO: 105630
  derived and/or modified sequence opt2 from neuraminidase__InfluenzaA__AFG71967

SEQ ID NO: 113430 - RNA, 1410 nt, Artificial Sequence; identical to SEQ ID NO: 105630
  derived and/or modified sequence opt2 from neuraminidase__InfluenzaA__AFG71978

SEQ ID NO: 113431 - RNA, 1410 nt, Artificial Sequence
  derived and/or modified sequence opt2 from neuraminidase__InfluenzaA__AFG71988
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcaucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113432 - RNA, 1410 nt, Artificial Sequence; identical to SEQ ID NO: 105630
  derived and/or modified sequence opt2 from neuraminidase__InfluenzaA__AFG71999

SEQ ID NO: 113433 - RNA, 1410 nt, Artificial Sequence; identical to SEQ ID NO: 106088
  derived and/or modified sequence opt2 from neuraminidase__InfluenzaA__AFG72021

SEQ ID NO: 113434 - RNA, 1410 nt, Artificial Sequence
  derived and/or modified sequence opt2 from neuraminidase__InfluenzaA__AFG72032
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113435 - RNA, 1410 nt, Artificial Sequence; identical to SEQ ID NO: 106325
  derived and/or modified sequence opt2 from neuraminidase__InfluenzaA__AFG72088

SEQ ID NO: 113436 - RNA, 1410 nt, Artificial Sequence
  derived and/or modified sequence opt2 from neuraminidase__InfluenzaA__AFG72121
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccgcgucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113437 - RNA, 1410 nt, Artificial Sequence
  derived and/or modified sequence opt2 from neuraminidase__InfluenzaA__AFG72143
augaaccccaaccagaagaucaucaccaucggcuccgucucccucaccaucgccaccaucugccuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113438 - RNA, 1410 nt, Artificial Sequence
  derived and/or modified sequence opt2 from neuraminidase__InfluenzaA__AFG72165
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113439 - RNA, 1410 nt, Artificial Sequence
  derived and/or modified sequence opt2 from neuraminidase__InfluenzaA__AFG72176
augaaccccaaccagaagaucaucaccaucggcuccgucucccucaccaucgccaccaucugcuuccucaugcagaucaccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaagugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacaaggucugguggaccuccaacuccaucgucgucuucugcggcaccuccggcaccuacggcaccggcuccuggcccgacggcgccgacaucaaccucaugcccaucuga

SEQ ID NO: 113440 - RNA, 1410 nt, Artificial Sequence; identical to SEQ ID NO: 113438
  derived and/or modified sequence opt2 from neuraminidase__InfluenzaA__AFG72198

SEQ ID NO: 113441 - RNA, 1410 nt, Artificial Sequence; identical to SEQ ID NO: 113438
  derived and/or modified sequence opt2 from neuraminidase__InfluenzaA__AFG72209

SEQ ID NO: 113442 - RNA, 1410 nt, Artificial Sequence
  derived and/or modified sequence opt2 from neuraminidase__InfluenzaA__AFG72220
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucguccaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113443 - RNA, 1410 nt, Artificial Sequence; identical to SEQ ID NO: 113438
  derived and/or modified sequence opt2 from neuraminidase__InfluenzaA__AFG72231

SEQ ID NO: 113444 - RNA, 1410 nt, Artificial Sequence
  derived and/or modified sequence opt2 from neuraminidase__InfluenzaA__AFG72297
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagcgcgagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113445 - RNA, 1410 nt, Artificial Sequence
  derived and/or modified sequence opt2 from neuraminidase__InfluenzaA__AFG72308
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuuccgcgucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113446 - RNA, 1410 nt, Artificial Sequence; identical to SEQ ID NO: 106697
  derived and/or modified sequence opt2 from neuraminidase__InfluenzaA__AFG72320

SEQ ID NO: 113447 - RNA, 1410 nt, Artificial Sequence
  derived and/or modified sequence opt2 from neuraminidase__InfluenzaA__AFG72331
augaaccccaaccagaagaucaucaccaucggcuccgucucccucaccgucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113448 - RNA, 1410 nt, Artificial Sequence
  derived and/or modified sequence opt2 from neuraminidase__InfluenzaA__AFG72353
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgacuccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113449 - RNA, 1410 nt, Artificial Sequence; identical to SEQ ID NO: 106697
  derived and/or modified sequence opt2 from neuraminidase__InfluenzaA__AFG72364

SEQ ID NO: 113450 - RNA, 1410 nt, Artificial Sequence
  derived and/or modified sequence opt2 from neuraminidase__InfluenzaA__AFG72430
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccaacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113451 - RNA, 1410 nt, Artificial Sequence; identical to SEQ ID NO: 106697
  derived and/or modified sequence opt2 from neuraminidase__InfluenzaA__AFG72452

SEQ ID NO: 113452 - RNA, 1410 nt, Artificial Sequence
  derived and/or modified sequence opt2 from neuraminidase__InfluenzaA__AFG72474
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113453 - RNA, 1410 nt, Artificial Sequence
  derived and/or modified sequence opt2 from neuraminidase__InfluenzaA__AFG72485
augaaccccaaccagaagaucaucaccaucggcuccgucucccucaccaucgccaccaucugcuuccucaugcagaucgccauccucgucaccaccgucacccuccacuucaagcagcacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113454 - RNA, 1410 nt, Artificial Sequence; identical to SEQ ID NO: 106613
  derived and/or modified sequence opt2 from neuraminidase__InfluenzaA__AFG72507

SEQ ID NO: 113455 - RNA, 1410 nt, Artificial Sequence
  derived and/or modified sequence opt2 from neuraminidase__InfluenzaA__AFG72529
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccagaaccccaacaacgagaacggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113456 - RNA, 1410 nt, Artificial Sequence
  derived and/or modified sequence opt2 from neuraminidase__InfluenzaA__AFG72540
augaaccccaaccagaagaucaucaccaucggcuccgucucccucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucaagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113457 - RNA, 1410 nt, Artificial Sequence
  derived and/or modified sequence opt2 from neuraminidase__InfluenzaA__AFG72562
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113458 - RNA, 1410 nt, Artificial Sequence
  derived and/or modified sequence opt2 from neuraminidase__InfluenzaA__AFG72584
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggaggucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagaaggccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113459 - RNA, 1410 nt, Artificial Sequence
  derived and/or modified sequence opt2 from neuraminidase__InfluenzaA__AFG72606
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113460 - RNA, 1410 nt, Artificial Sequence
  derived and/or modified sequence opt2 from neuraminidase__InfluenzaA__AFG72617
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113461 - RNA, 1410 nt, Artificial Sequence
  derived and/or modified sequence opt2 from neuraminidase__InfluenzaA__AFG72628
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113462 - RNA, 1410 nt, Artificial Sequence; identical to SEQ ID NO: 106492
  derived and/or modified sequence opt2 from neuraminidase__InfluenzaA__AFG72639

SEQ ID NO: 113463 - RNA, 1410 nt, Artificial Sequence
  derived and/or modified sequence opt2 from neuraminidase__InfluenzaA__AFG72650
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113464 - RNA, 1410 nt, Artificial Sequence; identical to SEQ ID NO: 113461
  derived and/or modified sequence opt2 from neuraminidase__InfluenzaA__AFG72672

SEQ ID NO: 113465 - RNA, 1407 nt, Artificial Sequence
  derived and/or modified sequence opt2 from neuraminidase__InfluenzaA__AFG72683
augaaccccaaccagaagaucaucaccaucggcuccgucucccucaccaucgccaccaucugcuuccucaugcagaucgccauccucgucaucaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgagguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113466 - RNA, 1410 nt, Artificial Sequence
  derived and/or modified sequence opt2 from neuraminidase__InfluenzaA__AFG72705
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggaccacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113467 - RNA, 1410 nt, Artificial Sequence
  derived and/or modified sequence opt2 from neuraminidase__InfluenzaA__AFG72716
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagucccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgccgccaggagaccgaggucugguggaccuccaacuccaucgucgucuucugcggcaccuccggcaccuacggcaccggcuccuggcccgacggcgccgacaucaaccucaugcccaucuga

SEQ ID NO: 113468 - RNA, 1410 nt, Artificial Sequence
  derived and/or modified sequence opt2 from neuraminidase__InfluenzaA__AFG72738
augaaccccaaccagaagaucaucaccaucggcuccgucucccucaccaucaccaccaucugcuuccucaugcagaucgccauccucgucaucaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucgaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113469 - RNA, 1410 nt, Artificial Sequence; identical to SEQ ID NO: 106697
  derived and/or modified sequence opt2 from neuraminidase__InfluenzaA__AFG72749

SEQ ID NO: 113470 - RNA, 1410 nt, Artificial Sequence; identical to SEQ ID NO: 106085
  derived and/or modified sequence opt2 from neuraminidase__InfluenzaA__AFG72760

SEQ ID NO: 113471 - RNA, 1410 nt, Artificial Sequence; identical to SEQ ID NO: 105552
  derived and/or modified sequence opt2 from neuraminidase__InfluenzaA__AFG72771

SEQ ID NO: 113472 - RNA, 1410 nt, Artificial Sequence
  derived and/or modified sequence opt2 from neuraminidase__InfluenzaA__AFG72782
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaccucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113473 - RNA, 1410 nt, Artificial Sequence; identical to SEQ ID NO: 107261
  derived and/or modified sequence opt2 from neuraminidase__InfluenzaA__AFG72793

SEQ ID NO: 113474 - RNA, 1410 nt, Artificial Sequence; identical to SEQ ID NO: 105796
  derived and/or modified sequence opt2 from neuraminidase__InfluenzaA__AFG72804

SEQ ID NO: 113475 - RNA, 1410 nt, Artificial Sequence; identical to SEQ ID NO: 107441
  derived and/or modified sequence opt2 from neuraminidase__InfluenzaA__AFG72826

SEQ ID NO: 113476 - RNA, 1410 nt, Artificial Sequence
  derived and/or modified sequence opt2 from neuraminidase__InfluenzaA__AFG72837
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113477 - RNA, 1413 nt, Artificial Sequence
  derived and/or modified sequence opt2 from neuraminidase__InfluenzaA__AFG72848
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaaguccgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaaguacauccuccgcacccaggaguccgagugcgucugcaucaacggcaccugcaccgucgucaugaccgacggcuccgccuccggcaaggccgacaccaagauccucuucaucgaggagggcaagaucauccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113478 - RNA, 1410 nt, Artificial Sequence
  derived and/or modified sequence opt2 from neuraminidase__InfluenzaA__AFG72859
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucgucuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113479 - RNA, 1410 nt, Artificial Sequence
  derived and/or modified sequence opt2 from neuraminidase__InfluenzaA__AFG72870
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccaccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgaguccaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113480 - RNA, 1410 nt, Artificial Sequence
  derived and/or modified sequence opt2 from neuraminidase__InfluenzaA__AFG72892
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggagaagaccgagguccucuggaccuccaacuccaucgucgucuucugcggcaccuccggcaccuacggcaccggcuccuggcccgacggcgccgacaucaaccucaugcccaucuga

SEQ ID NO: 113481 - RNA, 1410 nt, Artificial Sequence
  derived and/or modified sequence opt2 from neuraminidase__InfluenzaA__AFG72903
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucuccuccuacgucugcuccggccucgucggcgacaccccccgcaagaaggacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaccccaacuccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113482 - RNA, 1410 nt, Artificial Sequence
  derived and/or modified sequence opt2 from neuraminidase__InfluenzaA__AFG72936
augaaccccaaccagaagaucaucaccaucggcuccgucucccucaccaucuccaccaucugcuucuucauccagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccacaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113483 - RNA, 1410 nt, Artificial Sequence
  derived and/or modified sequence opt2 from neuraminidase__InfluenzaA__AFG72958
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113484 - RNA, 1410 nt, Artificial Sequence; identical to SEQ ID NO: 105615
  derived and/or modified sequence opt2 from neuraminidase__InfluenzaA__AFG98811

SEQ ID NO: 113485 - RNA, 1410 nt, Artificial Sequence
  derived and/or modified sequence opt2 from neuraminidase__InfluenzaA__AFG98822
augaaccccaaccagaagaucaucaccaucggcuccgucucccucaucaucgccaccgucugcuuccucaugcagaucgccauccucgucaccaccgucacccuccacuucaagcagcacgagugcgacucccccuccuccaaccaggucaugcucugcgagcccaucaucaucgagcgcaacaucaccgagaucgucuaccucaacaacaccaccaucgagaaggagaccugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacacccgcauccucuucaucgaggagggcaagaucguccacaucuccccccucuccggcuccgcccagcacgucgaggagugcuccugcuacccccgcuaccccgacguccgcugcaucugccgcgacaacuggaagggcuccaaccgccccaucgucgacaucaacaugaaggacuacuccaucgacuccuccuacgucugcuccggccucgucggcgacaccccccgcaacgacgaccgcuccuccaaguccaacugccgcaaccccaacaacgagcgcggcaaccacggcgucaagggcugggccuucgacaacggcaacgacgucuggaugggccgcaccaucuccaaggaccuccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccaacaucaacuucaugcccaucuga

SEQ ID NO: 113486 - RNA, 1410 nt, Artificial Sequence; identical to SEQ ID NO: 111639
  derived and/or modified sequence opt2 from neuraminidase__InfluenzaA__AFG98833

SEQ ID NO: 113487 - RNA, 1410 nt, Artificial Sequence
  derived and/or modified sequence opt2 from neuraminidase__InfluenzaA__AFG98844
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaugugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccauccacgaccgcaucccccaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacgacggccgccucgucgacuccaucggcuccuggucccagaacauccuccgcacccaggaguccgagugcgucugcaucaaccgcaccugcaccgucgucaugaccgacggcuccgccuccggcaaggccgacacccgcauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagcgcggcaaccacggcgucaagggcugggccuucgacgacgagaacgacgucuggaugggccgcaccaucuccaaggacucccgcuccggcuacgagaccuucaaggucaucggcggcugguccacccccaacuccaagucccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113488 - RNA, 1410 nt, Artificial Sequence; identical to SEQ ID NO: 105630
  derived and/or modified sequence opt2 from neuraminidase__InfluenzaA__AFG98855

SEQ ID NO: 113489 - RNA, 1410 nt, Artificial Sequence; identical to SEQ ID NO: 106484
  derived and/or modified sequence opt2 from neuraminidase__InfluenzaA__AFG98866

SEQ ID NO: 113490 - RNA, 1410 nt, Artificial Sequence
  derived and/or modified sequence opt2 from neuraminidase__InfluenzaA__AFG98877
augaaccccaaccagaagaucaucaccaucggcuccgucucccucaccaucgccaccaucugcuuccucaugcagaucgccauccucgucaccaccgucacccuccacuucaagcaguacgagugcgacuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113491 - RNA, 1410 nt, Artificial Sequence; identical to SEQ ID NO: 105630
  derived and/or modified sequence opt2 from neuraminidase__InfluenzaA__AFG98888

SEQ ID NO: 113492 - RNA, 1410 nt, Artificial Sequence
  derived and/or modified sequence opt2 from neuraminidase__InfluenzaA__AFG98899
augaaccccaaccagaagaucaucaccaucggcuccgucucccucaucaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113493 - RNA, 1410 nt, Artificial Sequence; identical to SEQ ID NO: 105630
  derived and/or modified sequence opt2 from neuraminidase__InfluenzaA__AFG98910

SEQ ID NO: 113494 - RNA, 1410 nt, Artificial Sequence; identical to SEQ ID NO: 105630
  derived and/or modified sequence opt2 from neuraminidase__InfluenzaA__AFG98921

SEQ ID NO: 113495 - RNA, 1410 nt, Artificial Sequence
  derived and/or modified sequence opt2 from neuraminidase__InfluenzaA__AFG98932
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucgucgagcgcaacaucaccgagaucgucuaccucaccaacaccaccaucgagaaggagaucugccccaagcucgucgaguaccgcaagugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113496 - RNA, 1410 nt, Artificial Sequence
  derived and/or modified sequence opt2 from neuraminidase__InfluenzaA__AFG98943
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucgaccucaugcccaucuga

SEQ ID NO: 113497 - RNA, 1410 nt, Artificial Sequence
  derived and/or modified sequence opt2 from neuraminidase__InfluenzaA__AFG98965
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaccaucaucgagcgcaacaucaccgagaucgucuaccucaccaacaucaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccaacuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcgccggcuccuggcccgacggcgccgacaucaaccucaugcccaucuga

SEQ ID NO: 113498 - RNA, 1410 nt, Artificial Sequence
  derived and/or modified sequence opt2 from neuraminidase__InfluenzaA__AFG98976
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucgccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcgucuucuccgucgagggcaaguccugcaucaaccgcugcuucuacgucgagcucauccgcggccgcgagcucgagacccgcgucugguggaccuccaacuccaucgucgucuucugcggcaccuccggcaccuacggcaccggcuccuggcccgacggcgccgacaucaaccucaugcccaucuga

SEQ ID NO: 113499 - RNA, 1410 nt, Artificial Sequence; identical to SEQ ID NO: 113498
  derived and/or modified sequence opt2 from neuraminidase__InfluenzaA__AFG98987

SEQ ID NO: 113500 - RNA, 1410 nt, Artificial Sequence
  derived and/or modified sequence opt2 from neuraminidase__InfluenzaA__AFG98998
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgagaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgccaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113501 - RNA, 1410 nt, Artificial Sequence; identical to SEQ ID NO: 113498
  derived and/or modified sequence opt2 from neuraminidase__InfluenzaA__AFG99009

SEQ ID NO: 113502 - RNA, 1410 nt, Artificial Sequence
  derived and/or modified sequence opt2 from neuraminidase__InfluenzaA__AFG99020
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaacaucaugcccaucuga

SEQ ID NO: 113503 - RNA, 1410 nt, Artificial Sequence
  derived and/or modified sequence opt2 from neuraminidase__InfluenzaA__AFG99031
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccccccucuccggcuccgcccagcacgucgaggagugcuccugcuacccccgcuaccccggcguccgcugcaucugccgcgacaacuggcgcggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucguccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113504 - RNA, 1410 nt, Artificial Sequence; identical to SEQ ID NO: 106088
  derived and/or modified sequence opt2 from neuraminidase__InfluenzaA__AFG99042

SEQ ID NO: 113505 - RNA, 1410 nt, Artificial Sequence
  derived and/or modified sequence opt2 from neuraminidase__InfluenzaA__AFG99053
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccuggucccagaacauccuccgcacccaggaguccgagugcgucugcaucaacggcaccugcaccgucgucaugaccgacggcuccgccuccggccgcgccgacaccaagauccucuucaucgaggagggcaagaucguccacaccuccucccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgacuccuccuacgucugcuccggccucgucggcgacaccccccgcaacaacgaccgcuccuccuccuccuacugccgcaaccccaacaacgagaagggcacccacggcgucaagggcugggccuucgacgacggcaacgacgucuggaugggccgcaccaucuccgaggacucccgcuccggcuacgagaccuucaaggucaucggcggcugguccauccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113506 - RNA, 1410 nt, Artificial Sequence
  derived and/or modified sequence opt2 from neuraminidase__InfluenzaA__AFG99064
augaaccccaaccagaagaucaucaccaucggcuccgucucccucaccaucgccaccgucugcuuccucaugcagaucgccauccucgucaccaccgucacccuccacuucaagcaguacgagugcgacuccccccccaacaaccaggucaugcccugcgagcccaucaucaucgagcgcaacgucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucgacaacaagcacuccaacgacaccauccacgaccgcaccccccaccgcacccuccucaugaacgagcucggcguccccuuccaccucggcacccgccaggucugcaucgccugguccuccuccuccugccacgacggcaaggccuggcuccacgucugcaucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113507 - RNA, 1410 nt, Artificial Sequence
  derived and/or modified sequence opt2 from neuraminidase__InfluenzaA__AFG99086
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacgucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113508 - RNA, 1410 nt, Artificial Sequence
  derived and/or modified sequence opt2 from neuraminidase__InfluenzaA__AFG99097
augaaccccaaccagaagaucaucaccaucggcuccgucucccucaccaucgccaccaucugcuuccucaugcagaucgccauccucgucaccaccgucacccuccacuucaagcaguacgagugcgacucccccgccaacaaccaggucaugcccugcgagcccaucaucaucgagcgcaacgucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcuacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcaucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgccucggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113509 - RNA, 1410 nt, Artificial Sequence
  derived and/or modified sequence opt2 from neuraminidase__InfluenzaA__AFG99119
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113510 - RNA, 1410 nt, Artificial Sequence
  derived and/or modified sequence opt2 from neuraminidase__InfluenzaA__AFG99130
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcggccccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaccaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113511 - RNA, 1410 nt, Artificial Sequence
  derived and/or modified sequence opt2 from neuraminidase__InfluenzaA__AFG99141
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgagaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113512 - RNA, 1410 nt, Artificial Sequence
  derived and/or modified sequence opt2 from neuraminidase__InfluenzaA__AFG99152
augaaccccaaccagaagaucaugaccaucggcuccgucucccucaccaucgccaccaucugcuuccucaugcagaucgccauccucgucaccaccgucacccuccacuucaagcacuacgaguucuccuccccccccaacaaccaggucaugcccugcgagcccaucaucaucgagcgcaacaucaccgagaucgucuaccucaccaacaccaccaucgagaaggaggucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcguccucuggaccuccaacuccaucgucgucuucugcggcaccuccggcaccuacggcaccggcuccuggcccgacggcgccgacaucaaccucaugcccaucuga

SEQ ID NO: 113513 - RNA, 1410 nt, Artificial Sequence; identical to SEQ ID NO: 110507
  derived and/or modified sequence opt2 from neuraminidase__InfluenzaA__AFG99163

SEQ ID NO: 113514 - RNA, 1410 nt, Artificial Sequence
  derived and/or modified sequence opt2 from neuraminidase__InfluenzaA__AFG99174
augaaccccucccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucauggaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucgacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgagaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccgucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucuccgaggagucccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113515 - RNA, 1410 nt, Artificial Sequence
  derived and/or modified sequence opt2 from neuraminidase__InfluenzaA__AFG99185
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccaagaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113516 - RNA, 1410 nt, Artificial Sequence
  derived and/or modified sequence opt2 from neuraminidase__InfluenzaA__AFG99196
augaaccccaaccagaagaucaucaccaucggcuccgucucccucaccaucgccaccaucugcuuccucacccagaucgccauccucgucaccaccgucacccuccacuucaagcaguacgagugcuccuccucccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcaucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113517 - RNA, 1410 nt, Artificial Sequence
  derived and/or modified sequence opt2 from neuraminidase__InfluenzaA__AFG99207
augaaccccaaccagaagaucaucaccaucggcuccgucucccucaccaucgccaccaucugcuuccucaugcagaucgccauccucgucaccaccgucacccuccacuucaagcccuacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccaagucccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113518 - RNA, 1410 nt, Artificial Sequence; identical to SEQ ID NO: 106326
  derived and/or modified sequence opt2 from neuraminidase__InfluenzaA__AFG99218

SEQ ID NO: 113519 - RNA, 1410 nt, Artificial Sequence
  derived and/or modified sequence opt2 from neuraminidase__InfluenzaA__AFG99229
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccaagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccaagaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113520 - RNA, 1410 nt, Artificial Sequence
  derived and/or modified sequence opt2 from neuraminidase__InfluenzaA__AFG99240
augaaccccaaccagaagaucaucaccaucggcuccgucucccucaccaucgccaccaucugcuuccucaugcagaucgccauccucgucaccaccgucacccuccacuucaagcaguacgagugcuccuccccccccuccaaccaggucaugcccugcgagcccaucaucaucgagcgcaacaucaccgagaucgucuaccucaccaacaccaccaucgagaaggagaucugccccaagcccgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuucuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccaagaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113521 - RNA, 1410 nt, Artificial Sequence; identical to SEQ ID NO: 106325
  derived and/or modified sequence opt2 from neuraminidase__InfluenzaA__AFG99251

SEQ ID NO: 113522 - RNA, 1410 nt, Artificial Sequence
  derived and/or modified sequence opt2 from neuraminidase__InfluenzaA__AFG99273
augaaccccaaccagaagaucaucaccaucggcuccgucucccucaccaucgccaccaugugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113523 - RNA, 1410 nt, Artificial Sequence
  derived and/or modified sequence opt2 from neuraminidase__InfluenzaA__AFG99284
augaaccccaaccagaagaucaucaccaucggcuccgucucccucaccaucgccaccaucugcuuccucaugcagaucgccauccucgucaccaccgucacccuccacuucaagcaguacgagugcuccuccccccccuccaaccaggucaugcccugcgagcccaucaucaucgagcgcaacaucaccaagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucaacaacaagcacuccaacgacaccauccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgacaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccaagaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113524 - RNA, 1410 nt, Artificial Sequence
  derived and/or modified sequence opt2 from neuraminidase__InfluenzaA__AFG99295
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucaucuccuccuacgucugcuccggccucgucggcgacaccccccgcaagaacgaccgcuccuccuccuccuacugccagaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113525 - RNA, 1410 nt, Artificial Sequence
  derived and/or modified sequence opt2 from neuraminidase__InfluenzaA__AFG99317
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaacaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucgacgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113526 - RNA, 1410 nt, Artificial Sequence
  derived and/or modified sequence opt2 from neuraminidase__InfluenzaA__AFG99328
augaaccccaaccagaagaucaucaccaucggcuccgucucccucacccucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucaacaaccgccacuccaacgacaccguccacgaccgcacccccuaccgcacccuccucaugaacgagcucggcguccccuuccaccucggcacccgccaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacguccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcaacgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113527 - RNA, 1410 nt, Artificial Sequence
  derived and/or modified sequence opt2 from neuraminidase__InfluenzaA__AFG99350
augaaccccaaccagaagaucaucaccaucggcuccgucucccucacccucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucaacaaccgccacuccaacgacaccguccacgaccgcacccccuaccgcacccuccucaugaacgagcucggcguccccuuccaccucggcacccgccaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113528 - RNA, 1410 nt, Artificial Sequence
  derived and/or modified sequence opt2 from neuraminidase__InfluenzaA__AFG99361
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaagugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113529 - RNA, 1410 nt, Artificial Sequence
  derived and/or modified sequence opt2 from neuraminidase__InfluenzaA__AFG99383
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113530 - RNA, 1410 nt, Artificial Sequence; identical to SEQ ID NO: 113529
  derived and/or modified sequence opt2 from neuraminidase__InfluenzaA__AFG99394

SEQ ID NO: 113531 - RNA, 1410 nt, Artificial Sequence
  derived and/or modified sequence opt2 from neuraminidase__InfluenzaA__AFG99405
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucaucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113532 - RNA, 1410 nt, Artificial Sequence
  derived and/or modified sequence opt2 from neuraminidase__InfluenzaA__AFG99416
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucauccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacggcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113533 - RNA, 1410 nt, Artificial Sequence
  derived and/or modified sequence opt2 from neuraminidase__InfluenzaA__AFG99427
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggaggucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucauccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113534 - RNA, 1410 nt, Artificial Sequence
  derived and/or modified sequence opt2 from neuraminidase__InfluenzaA__AFG99438
augaaccccaaccagaagaucaucaccaucggcuccgucucccucaccaucgccaccaucugcuuccucaugcagaucgccauccucgucaccaccgucacccuccacuuccgccaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113535 - RNA, 1410 nt, Artificial Sequence
  derived and/or modified sequence opt2 from neuraminidase__InfluenzaA__AFG99449
augaaccccaaccagaagaucaucaccaucggcuccgucucccucaccaucgccaccaucugcuuccucaugcagaucgccauccucgucaccaccgucacccuccacuuccgccaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaagaacugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113536 - RNA, 1410 nt, Artificial Sequence
  derived and/or modified sequence opt2 from neuraminidase__InfluenzaA__AFG99471
augaaccccaaccagaagaucaucaccaucggcuccgucucccucauccucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcaaccccuaccgcacccuccucaugaacgagcucggcguccccuuccaccucggcacccgccaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113537 - RNA, 1410 nt, Artificial Sequence
  derived and/or modified sequence opt2 from neuraminidase__InfluenzaA__AFG99482
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaagaacugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucauguccaucuga

SEQ ID NO: 113538 - RNA, 1410 nt, Artificial Sequence
  derived and/or modified sequence opt2 from neuraminidase__InfluenzaA__AFG99493
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113539 - RNA, 1410 nt, Artificial Sequence
  derived and/or modified sequence opt2 from neuraminidase__InfluenzaA__AFG99504
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113540 - RNA, 1410 nt, Artificial Sequence
  derived and/or modified sequence opt2 from neuraminidase__InfluenzaA__AFG99515
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113541 - RNA, 1410 nt, Artificial Sequence
  derived and/or modified sequence opt2 from neuraminidase__InfluenzaA__AFG99526
augaaccccaaccagaagaucaucaccaucggcuccgucucccucacccucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggaggucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcacccgccaggucugcauggccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113542 - RNA, 1410 nt, Artificial Sequence; identical to SEQ ID NO: 113438
  derived and/or modified sequence opt2 from neuraminidase__InfluenzaA__AFG99537

SEQ ID NO: 113543 - RNA, 1410 nt, Artificial Sequence; identical to SEQ ID NO: 113438
  derived and/or modified sequence opt2 from neuraminidase__InfluenzaA__AFG99548

SEQ ID NO: 113544 - RNA, 1410 nt, Artificial Sequence; identical to SEQ ID NO: 113438
  derived and/or modified sequence opt2 from neuraminidase__InfluenzaA__AFG99559

SEQ ID NO: 113545 - RNA, 1410 nt, Artificial Sequence; identical to SEQ ID NO: 113438
  derived and/or modified sequence opt2 from neuraminidase__InfluenzaA__AFG99570

SEQ ID NO: 113546 - RNA, 1410 nt, Artificial Sequence; identical to SEQ ID NO: 113438
  derived and/or modified sequence opt2 from neuraminidase__InfluenzaA__AFG99581

SEQ ID NO: 113547 - RNA, 1410 nt, Artificial Sequence
  derived and/or modified sequence opt2 from neuraminidase__InfluenzaA__AFG99592
augaaccccaaccagaagaucaucaccaucggcuccgucucccucaccaucgccaccaccugcuuccucaugcagaucgccauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113548 - RNA, 1410 nt, Artificial Sequence; identical to SEQ ID NO: 113438
  derived and/or modified sequence opt2 from neuraminidase__InfluenzaA__AFG99603

SEQ ID NO: 113549 - RNA, 1410 nt, Artificial Sequence; identical to SEQ ID NO: 113438
  derived and/or modified sequence opt2 from neuraminidase__InfluenzaA__AFG99614

SEQ ID NO: 113550 - RNA, 1410 nt, Artificial Sequence; identical to SEQ ID NO: 113438
  derived and/or modified sequence opt2 from neuraminidase__InfluenzaA__AFG99625

SEQ ID NO: 113551 - RNA, 1410 nt, Artificial Sequence
  derived and/or modified sequence opt2 from neuraminidase__InfluenzaA__AFG99636
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggaccuccgcuccggcuacgagaccuucaaggucaucggcggcugguccacccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113552 - RNA, 1410 nt, Artificial Sequence
  derived and/or modified sequence opt2 from neuraminidase__InfluenzaA__AFG99658
augaaccccaaccagaagaucaucaccaucggcuccgucucccucaccaucgccaccaucugcuuccucaugcagaucaccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucuccuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacaaggucugguggaccuccaacuccaucgucgucuucugcggcaccuccggcaccuacggcaccggcuccuggcccgacggcgccgacaucaaccucaugcccaucuga

SEQ ID NO: 113553 - RNA, 1410 nt, Artificial Sequence
  derived and/or modified sequence opt2 from neuraminidase__InfluenzaA__AFG99680
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucauccucugccagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaaggucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113554 - RNA, 1410 nt, Artificial Sequence
  derived and/or modified sequence opt2 from neuraminidase__InfluenzaA__AFG99691
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcccugcgagcccaccaucaucgagcgcaacaccaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113555 - RNA, 1410 nt, Artificial Sequence; identical to SEQ ID NO: 113438
  derived and/or modified sequence opt2 from neuraminidase__InfluenzaA__AFG99704

SEQ ID NO: 113556 - RNA, 1410 nt, Artificial Sequence; identical to SEQ ID NO: 113438
  derived and/or modified sequence opt2 from neuraminidase__InfluenzaA__AFG99715

SEQ ID NO: 113557 - RNA, 1410 nt, Artificial Sequence; identical to SEQ ID NO: 113438
  derived and/or modified sequence opt2 from neuraminidase__InfluenzaA__AFG99726

SEQ ID NO: 113558 - RNA, 1410 nt, Artificial Sequence
  derived and/or modified sequence opt2 from neuraminidase__InfluenzaA__AFG99737
augaaccccaaccagaagaucaucaccaucggcuccgucucccucaccaucgccaccaucugcuuccucaugcagaucaccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacaaggucugguggaccuccaacuccaucgucgucuucugcggcaccuccggcaccuacggcaccggcuccuggcccgacggcgccgacaucaaccucaugcccaucuga

SEQ ID NO: 113559 - RNA, 1410 nt, Artificial Sequence
  derived and/or modified sequence opt2 from neuraminidase__InfluenzaA__AFG99748
augaaccccaaccagaagaucaucaccaucggcuccgucucccucaccaucgccaccaucugcuuccucaugcagaucgccauccucgucaccaccgucacccuccacuucaagcaguacgacugcaacuccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaccaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113560 - RNA, 1410 nt, Artificial Sequence; identical to SEQ ID NO: 113438
  derived and/or modified sequence opt2 from neuraminidase__InfluenzaA__AFG99759

SEQ ID NO: 113561 - RNA, 1410 nt, Artificial Sequence
  derived and/or modified sequence opt2 from neuraminidase__InfluenzaA__AFG99770
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccagaucaugcucugcgagcccaccaucaucgagcgcaacaucaccgagaucgucuaccucaccaacaccaccaucgagcgcgagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113562 - RNA, 1410 nt, Artificial Sequence
  derived and/or modified sequence opt2 from neuraminidase__InfluenzaA__AFG99781
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcucugccagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccaagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaccaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113563 - RNA, 1410 nt, Artificial Sequence; identical to SEQ ID NO: 113438
  derived and/or modified sequence opt2 from neuraminidase__InfluenzaA__AFG99792

SEQ ID NO: 113564 - RNA, 1410 nt, Artificial Sequence; identical to SEQ ID NO: 113558
  derived and/or modified sequence opt2 from neuraminidase__InfluenzaA__AFG99803

SEQ ID NO: 113565 - RNA, 1410 nt, Artificial Sequence; identical to SEQ ID NO: 113438
  derived and/or modified sequence opt2 from neuraminidase__InfluenzaA__AFG99825

SEQ ID NO: 113566 - RNA, 1410 nt, Artificial Sequence; identical to SEQ ID NO: 113438
  derived and/or modified sequence opt2 from neuraminidase__InfluenzaA__AFG99836

SEQ ID NO: 113567 - RNA, 1410 nt, Artificial Sequence; identical to SEQ ID NO: 113438
  derived and/or modified sequence opt2 from neuraminidase__InfluenzaA__AFG99847

SEQ ID NO: 113568 - RNA, 1410 nt, Artificial Sequence; identical to SEQ ID NO: 113438
  derived and/or modified sequence opt2 from neuraminidase__InfluenzaA__AFG99858

SEQ ID NO: 113569 - RNA, 1410 nt, Artificial Sequence; identical to SEQ ID NO: 113438
  derived and/or modified sequence opt2 from neuraminidase__InfluenzaA__AFG99869

SEQ ID NO: 113570 - RNA, 1410 nt, Artificial Sequence; identical to SEQ ID NO: 113438
  derived and/or modified sequence opt2 from neuraminidase__InfluenzaA__AFG99880

SEQ ID NO: 113571 - RNA, 1410 nt, Artificial Sequence
  derived and/or modified sequence opt2 from neuraminidase__InfluenzaA__AFG99891
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuacuucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuuccgcgucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113572 - RNA, 1410 nt, Artificial Sequence; identical to SEQ ID NO: 113438
  derived and/or modified sequence opt2 from neuraminidase__InfluenzaA__AFG99902

SEQ ID NO: 113573 - RNA, 1410 nt, Artificial Sequence; identical to SEQ ID NO: 113438
  derived and/or modified sequence opt2 from neuraminidase__InfluenzaA__AFG99913

SEQ ID NO: 113574 - RNA, 1410 nt, Artificial Sequence; identical to SEQ ID NO: 113438
  derived and/or modified sequence opt2 from neuraminidase__InfluenzaA__AFG99924

SEQ ID NO: 113575 - RNA, 1410 nt, Artificial Sequence
  derived and/or modified sequence opt2 from neuraminidase__InfluenzaA__AFG99935
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucgucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccuccaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacaugaaggacuacuccaucgucuccuccuacgucugcuccggccucgucggcgacaccccccgcaacaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113576 - RNA, 1410 nt, Artificial Sequence; identical to SEQ ID NO: 113438
  derived and/or modified sequence opt2 from neuraminidase__InfluenzaA__AFG99946

SEQ ID NO: 113577 - RNA, 1410 nt, Artificial Sequence
  derived and/or modified sequence opt2 from neuraminidase__InfluenzaA__AFG99957
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggccaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaccaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113578 - RNA, 1410 nt, Artificial Sequence; identical to SEQ ID NO: 113438
  derived and/or modified sequence opt2 from neuraminidase__InfluenzaA__AFG99968

SEQ ID NO: 113579 - RNA, 1410 nt, Artificial Sequence
  derived and/or modified sequence opt2 from neuraminidase__InfluenzaA__AFG99979
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucgucuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaccaaccgccaggucaucgucgaccgcggcaaccgcuccggcuacuccggcaucuucuccgucgaguccaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113580 - RNA, 1410 nt, Artificial Sequence
  derived and/or modified sequence opt2 from neuraminidase__InfluenzaA__AFG99990
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggccaugcucugcgagcccaagaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113581 - RNA, 1410 nt, Artificial Sequence
  derived and/or modified sequence opt2 from neuraminidase__InfluenzaA__AFH00002
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucauccccugccagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcgccgucgucaugaccgacggcuccgccuccgagcgcgccgacaccaagauccucuucaucgaggagggcaaggucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaagaacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113582 - RNA, 1410 nt, Artificial Sequence; identical to SEQ ID NO: 106697
  derived and/or modified sequence opt2 from neuraminidase__InfluenzaA__AFH00013

SEQ ID NO: 113583 - RNA, 1410 nt, Artificial Sequence
  derived and/or modified sequence opt2 from neuraminidase__InfluenzaA__AFH00024
augaaccccaaccagaagaucaucaccaucggcuccgucucccucaccaucgccaccaucugcuuccucaugcagaucaccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggccgcaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaacaaggucugguggaccuccaacuccaucgucgucuucugcggcaccuccggcaccuacggcaccggcuccuggcccgacggcgccgacaucaaccucaugcccaucuga

SEQ ID NO: 113584 - RNA, 1410 nt, Artificial Sequence; identical to SEQ ID NO: 106697
  derived and/or modified sequence opt2 from neuraminidase__InfluenzaA__AFH00035

SEQ ID NO: 113585 - RNA, 1410 nt, Artificial Sequence; identical to SEQ ID NO: 106697
  derived and/or modified sequence opt2 from neuraminidase__InfluenzaA__AFH00046

SEQ ID NO: 113586 - RNA, 1410 nt, Artificial Sequence
  derived and/or modified sequence opt2 from neuraminidase__InfluenzaA__AFH00057
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacguccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113587 - RNA, 1410 nt, Artificial Sequence; identical to SEQ ID NO: 106697
  derived and/or modified sequence opt2 from neuraminidase__InfluenzaA__AFH00068

SEQ ID NO: 113588 - RNA, 1410 nt, Artificial Sequence
  derived and/or modified sequence opt2 from neuraminidase__InfluenzaA__AFH00079
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113589 - RNA, 1410 nt, Artificial Sequence
  derived and/or modified sequence opt2 from neuraminidase__InfluenzaA__AFH00090
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113590 - RNA, 1410 nt, Artificial Sequence
  derived and/or modified sequence opt2 from neuraminidase__InfluenzaA__AFH00101
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113591 - RNA, 1410 nt, Artificial Sequence; identical to SEQ ID NO: 106613
  derived and/or modified sequence opt2 from neuraminidase__InfluenzaA__AFH00112

SEQ ID NO: 113592 - RNA, 1410 nt, Artificial Sequence; identical to SEQ ID NO: 106613
  derived and/or modified sequence opt2 from neuraminidase__InfluenzaA__AFH00123

SEQ ID NO: 113593 - RNA, 1410 nt, Artificial Sequence
  derived and/or modified sequence opt2 from neuraminidase__InfluenzaA__AFH00156
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucaucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113594 - RNA, 1410 nt, Artificial Sequence
  derived and/or modified sequence opt2 from neuraminidase__InfluenzaA__AFH00167
augaaccccaaccagaagaucaucaccaucggcuccgucucccucaccaucgccaccaugugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113595 - RNA, 1410 nt, Artificial Sequence; identical to SEQ ID NO: 113593
  derived and/or modified sequence opt2 from neuraminidase__InfluenzaA__AFH00178

SEQ ID NO: 113596 - RNA, 1410 nt, Artificial Sequence
  derived and/or modified sequence opt2 from neuraminidase__InfluenzaA__AFH00189
augaaccccaaccagaagaucaucaccaucggcuccgucucccucaccaucgccaccaucugcuuccucaugcagaucgccauccucgucaccaccgucacccuccacuucaagcaguacgaguacaacuccccccccaacaaccaggucaugcucugcgagcccaagaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113597 - RNA, 1410 nt, Artificial Sequence; identical to SEQ ID NO: 106697
  derived and/or modified sequence opt2 from neuraminidase__InfluenzaA__AFH00200

SEQ ID NO: 113598 - RNA, 1410 nt, Artificial Sequence; identical to SEQ ID NO: 113594
  derived and/or modified sequence opt2 from neuraminidase__InfluenzaA__AFH00211

SEQ ID NO: 113599 - RNA, 1410 nt, Artificial Sequence
  derived and/or modified sequence opt2 from neuraminidase__InfluenzaA__AFH00222
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacaacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113600 - RNA, 1410 nt, Artificial Sequence; identical to SEQ ID NO: 106613
  derived and/or modified sequence opt2 from neuraminidase__InfluenzaA__AFH00233

SEQ ID NO: 113601 - RNA, 1410 nt, Artificial Sequence
  derived and/or modified sequence opt2 from neuraminidase__InfluenzaA__AFH00244
augaaccccaaccagaagaucaucaccaucggcuccgucucccucaccaucgccaccaucugcuuccucaugcagaucgccauccucgucaccaccgucacccucuacuucaagcaguacgagugcaacuccccccccuccaaccaggucaugcucugcgagcccaccaucgucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgccaagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113602 - RNA, 1410 nt, Artificial Sequence; identical to SEQ ID NO: 106697
  derived and/or modified sequence opt2 from neuraminidase__InfluenzaA__AFH00255

SEQ ID NO: 113603 - RNA, 1410 nt, Artificial Sequence; identical to SEQ ID NO: 106697
  derived and/or modified sequence opt2 from neuraminidase__InfluenzaA__AFH00266

SEQ ID NO: 113604 - RNA, 1410 nt, Artificial Sequence
  derived and/or modified sequence opt2 from neuraminidase__InfluenzaA__AFH00277
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaagcccaacaacgagaagggcucccacggccucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113605 - RNA, 1410 nt, Artificial Sequence; identical to SEQ ID NO: 106697
  derived and/or modified sequence opt2 from neuraminidase__InfluenzaA__AFH00288

SEQ ID NO: 113606 - RNA, 1410 nt, Artificial Sequence; identical to SEQ ID NO: 113529
  derived and/or modified sequence opt2 from neuraminidase__InfluenzaA__AFH00299

SEQ ID NO: 113607 - RNA, 1410 nt, Artificial Sequence
  derived and/or modified sequence opt2 from neuraminidase__InfluenzaA__AFH00310
augaaccccaaccagaagaucaucaccaucggcuccgucucccucaccaucgccaccaucugcuuccucaugcagaucgccauccucgucaccaccgucacccuccacuucaagcaguacgagugcuccuccucccccaacaaccaggucauccccugccagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagaaggccgacaccaagauccucuucaucgaggagggcaaggucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaagaacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcaagcaggagaccaaggucugguggaccuccaacucccucgucgucuucugcggcaccuccggcaccuacggcaccggcuccuggcccgacggcgccgacaucaaccucaugcccaucuga

SEQ ID NO: 113608 - RNA, 1410 nt, Artificial Sequence; identical to SEQ ID NO: 113607
  derived and/or modified sequence opt2 from neuraminidase__InfluenzaA__AFH00321

SEQ ID NO: 113609 - RNA, 1410 nt, Artificial Sequence
  derived and/or modified sequence opt2 from neuraminidase__InfluenzaA__AFH00332
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaagggcugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113610 - RNA, 1410 nt, Artificial Sequence
  derived and/or modified sequence opt2 from neuraminidase__InfluenzaA__AFH00343
augaaccccaaccagaagaucaucaccaucggcuccgucucccucaccaucgccaccaucugcuuccucaugcagaucgccauccucgucaccaccgucacccuccacuucaagcaguacgagugcaacuccccccccuccaaccaggccaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113611 - RNA, 1410 nt, Artificial Sequence
  derived and/or modified sequence opt2 from neuraminidase__InfluenzaA__AFH00354
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccaagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113612 - RNA, 1410 nt, Artificial Sequence; identical to SEQ ID NO: 106492
  derived and/or modified sequence opt2 from neuraminidase__InfluenzaA__AFH00365

SEQ ID NO: 113613 - RNA, 1410 nt, Artificial Sequence
  derived and/or modified sequence opt2 from neuraminidase__InfluenzaA__AFH00376
augaaccccaaccagaagaucaucaccaucggcuccgucucccucaccaucgccaccaucugcuuccucaugcagaucgccauccucgucaccaccgucacccuccacuucaagcagugcgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113614 - RNA, 1410 nt, Artificial Sequence
  derived and/or modified sequence opt2 from neuraminidase__InfluenzaA__AFH00387
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucuccuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113615 - RNA, 1410 nt, Artificial Sequence
  derived and/or modified sequence opt2 from neuraminidase__InfluenzaA__AFH00398
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcgucaaccgcugcuucuacgucgagcucauccgcggccgcaagcaggagaccgaggucugguggaccuccaacuccaucgucgucuucugcggcaccuccggcaccuacggcgccggcuccuggcccgacggcgccgacaucaaccucaugcccaucuga

SEQ ID NO: 113616 - RNA, 1410 nt, Artificial Sequence
  derived and/or modified sequence opt2 from neuraminidase__InfluenzaA__AFH00409
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113617 - RNA, 1410 nt, Artificial Sequence; identical to SEQ ID NO: 106492
  derived and/or modified sequence opt2 from neuraminidase__InfluenzaA__AFH00420

SEQ ID NO: 113618 - RNA, 1410 nt, Artificial Sequence; identical to SEQ ID NO: 106625
  derived and/or modified sequence opt2 from neuraminidase__InfluenzaA__AFH00431

SEQ ID NO: 113619 - RNA, 1410 nt, Artificial Sequence
  derived and/or modified sequence opt2 from neuraminidase__InfluenzaA__AFH00442
augaaccccaaccagaagaucaucaccaucggcuccgucucccucaccaucgccaccaucugcuuccucaugcagaucgccauccucgucaucaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113620 - RNA, 1410 nt, Artificial Sequence
  derived and/or modified sequence opt2 from neuraminidase__InfluenzaA__AFH00453
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgaggucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaucguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113621 - RNA, 1410 nt, Artificial Sequence
  derived and/or modified sequence opt2 from neuraminidase__InfluenzaA__AFH00464
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaagaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacggcggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113622 - RNA, 1410 nt, Artificial Sequence
  derived and/or modified sequence opt2 from neuraminidase__InfluenzaA__AFH00475
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcaaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113623 - RNA, 1410 nt, Artificial Sequence
  derived and/or modified sequence opt2 from neuraminidase__InfluenzaA__AFH00486
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113624 - RNA, 1410 nt, Artificial Sequence
  derived and/or modified sequence opt2 from neuraminidase__InfluenzaA__AFH00497
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucaagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugcuggaaccccaacaacgagaagggcggccacggcgucaagggcugggccuucgacgacggcaacgacgucuggaugggccgcaccaucuccgaggagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113625 - RNA, 1410 nt, Artificial Sequence
  derived and/or modified sequence opt2 from neuraminidase__InfluenzaA__AFH00508
augaaccccaaccagaagaucaucaccaucggcuccgucucccucaccaucgccaccaucugcuuccucaugcagaucgccauccucgucaucaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacaacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuuccgcgucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113626 - RNA, 1410 nt, Artificial Sequence
  derived and/or modified sequence opt2 from neuraminidase__InfluenzaA__AFH00519
augaaccccaaccagaagaucaucaccaucggcuccgucucccucaccaucgccaccaugugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaagcuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113627 - RNA, 1410 nt, Artificial Sequence; identical to SEQ ID NO: 106085
  derived and/or modified sequence opt2 from neuraminidase__InfluenzaA__AFH00530

SEQ ID NO: 113628 - RNA, 1410 nt, Artificial Sequence; identical to SEQ ID NO: 106085
  derived and/or modified sequence opt2 from neuraminidase__InfluenzaA__AFH00541

SEQ ID NO: 113629 - RNA, 1410 nt, Artificial Sequence
  derived and/or modified sequence opt2 from neuraminidase__InfluenzaA__AFH00552
augaaccccaaccagaagaucaucaccaucggcuccgucucccucaccaucgccaccaucugcuuccucaugcagaucgccauccucgucaccaccgucacccuccacuucaagcaguacgagugcaacucccuccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucauccacaucucccagcucuccggcuccacccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucgagggcugguccaagcccaacuccaagcuccagaucaaccgccaggucaucgucgaccgcgacaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113630 - RNA, 1410 nt, Artificial Sequence
  derived and/or modified sequence opt2 from neuraminidase__InfluenzaA__AFH00563
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgagcgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113631 - RNA, 1410 nt, Artificial Sequence
  derived and/or modified sequence opt2 from neuraminidase__InfluenzaA__AFH00574
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaagaucaucgagcgcaacaucaccgagaucgucuaccucaacaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaccucccuccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113632 - RNA, 1410 nt, Artificial Sequence
  derived and/or modified sequence opt2 from neuraminidase__InfluenzaA__AFH00585
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucaagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaaccgccacuccaacgacaagguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucaaggagggcaagaucguccacaccuccucccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaaggccaacuccaagcuccagaucaaccgccaggucaucgucgaccgcggcaaccgcuccggcuacuccggcaucuucuccgucgaguccaaguccugcaucaaccgcugcuucuacgucgagcucauccgcggccgcaagcaggagaccgagguccucuggaccuccaacuccaucgucgucuucugcggcaccuccggcaccuacggcaccggcuccuggcccgacggcgccgacaucaaccucaugcccaucuga

SEQ ID NO: 113633 - RNA, 1410 nt, Artificial Sequence; identical to SEQ ID NO: 106220
  derived and/or modified sequence opt2 from neuraminidase__InfluenzaA__AFH00596

SEQ ID NO: 113634 - RNA, 1410 nt, Artificial Sequence
  derived and/or modified sequence opt2 from neuraminidase__InfluenzaA__AFH00607
augaaccccaaccagaagaucaucaccaucggcuucgucuucuucaccaucgccaccaucugcuuccucaugcagaucgccauccucgucaccaccgucacccuccacuucaagcaguacgagugcaaccccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacgagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucguccacaucuccacccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuucuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaccaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113635 - RNA, 1410 nt, Artificial Sequence; identical to SEQ ID NO: 107441
  derived and/or modified sequence opt2 from neuraminidase__InfluenzaA__AFH00618

SEQ ID NO: 113636 - RNA, 1410 nt, Artificial Sequence
  derived and/or modified sequence opt2 from neuraminidase__InfluenzaA__AFH00629
augaaccccaaccagaagaucaucaccaucggcuccgucucccucaccaucgccaccaucugcuuccucaugcagaucaccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaagggcaucugccccaagcucgccgaguaccgcaacugguccaagccccagugcaacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacggccacuccaacgacaccguccacgaccgcacccccuaccgcacccuccucaugaacgagcucggcguccccuuccaccucggcacccgccaggucugcaucgccugguccuccuccuccugccacgacggcaaggccuggcuccacgucugcgucaccggcgacgacaagaacgccaccgccuccuucaucuacaacggccgccucgucgacuccaucggcuccugguccaagaagauccuccgcacccaggaguccgagugcgucugcaucaacggcaccugcaccgucgucaugaccgacggcuccgccuccggcaaggccgacaccaagauccucuucaucgaggagggcaagaucauccacaucuccacccuccucggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagcuccgcuccggcuacgagaccuucaaggucaucgagggcugguccaagcccaacuccaagcuccagaucaaccgccaggucaucgucgagcgcggcaaccgcuccggcuacuccggcaucuucuccgucgagggcaaguccugcaucaaccgcugcuucuacgucgagcucauccgcggccgcaaggaggagaccgaggucugguggaccuccaacuccaucgucgucuucugcggcaccuccggcaccuacggcaccggcuccuggcccgacggcgccgacaucaaccucaugcccaucuga

SEQ ID NO: 113637 - RNA, 1410 nt, Artificial Sequence; identical to SEQ ID NO: 105839
  derived and/or modified sequence opt2 from neuraminidase__InfluenzaA__AFH00640

SEQ ID NO: 113638 - RNA, 1410 nt, Artificial Sequence; identical to SEQ ID NO: 107968
  derived and/or modified sequence opt2 from neuraminidase__InfluenzaA__AFH00651

SEQ ID NO: 113639 - RNA, 1410 nt, Artificial Sequence; identical to SEQ ID NO: 105839
  derived and/or modified sequence opt2 from neuraminidase__InfluenzaA__AFH00662

SEQ ID NO: 113640 - RNA, 1410 nt, Artificial Sequence
  derived and/or modified sequence opt2 from neuraminidase__InfluenzaA__AFH00673
augaaccccaaccagaagaucaucaccaucggcuccgucucccucaccaucuccaccaucugcuucuucaugcagaucgccauccucaucaccaccgucacccuccacuucaagcaguacgaguucuccuccccccccaacaaccaggucaugcucugcgagcccaccaucaucgagcgcaacaucaccgagaucgucuaccucaccaacaccaccaucgagaaggagaccugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggacuacuccaucgucucccgcuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgucaagucccgcuccggcuacgagaccuucaaggucaucgagggcugguccaaccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113641 - RNA, 1410 nt, Artificial Sequence
  derived and/or modified sequence opt2 from neuraminidase__InfluenzaA__AFH00684
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgagcgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113642 - RNA, 1410 nt, Artificial Sequence
  derived and/or modified sequence opt2 from neuraminidase__InfluenzaA__AFH00695
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacgacaccguccgcgagcgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccaucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113643 - RNA, 1410 nt, Artificial Sequence
  derived and/or modified sequence opt2 from neuraminidase__InfluenzaA__AFH00706
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccaacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugcuucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggcuccaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113644 - RNA, 1410 nt, Artificial Sequence
  derived and/or modified sequence opt2 from neuraminidase__InfluenzaA__AFH00728
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaucaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaacaagcacuccaacgacaccauccacgaccgcacccccuaccgcacccuccucaugaacgagcucggcguccccuuccaccucggcacccgccaggucugcaucgccugguccuccuccuccugccacgacggcaaggccuggcuccacgucugcgucaccggccacgacaagaacgccaccgccuccuucaucuacaacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcaaccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccgacaaccgcuccggcuacuccggcaucuucuccgucgagggcaaguccugcaucaaccgcugcuucuacgucgagcucauccgcggccgcgagcaggagacccgcguccucuggaccuccaacuccaucgucgucuucugcggcaccuccggcaccuacggcaccggcuccuggcccgacggcgccgacaucaaccucaugcccaucuga

SEQ ID NO: 113645 - RNA, 1410 nt, Artificial Sequence
  derived and/or modified sequence opt2 from neuraminidase__InfluenzaA__AFH00739
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgacuccggcaaccgcuccggcuacuccggcaucuucuccgucgagggcaaguccugcaucaaccgcugcuucuacgucgagcucauccgcggccgcggccaggagacccgcgucugguggaccuccaacuccaucgucgucuucugcggcaccuccggcaccuacggcaccggcuccuggcccgacggcgccgacaucaaccucaugcccaucuga

SEQ ID NO: 113646 - RNA, 1410 nt, Artificial Sequence
  derived and/or modified sequence opt2 from neuraminidase__InfluenzaA__AFH00750
augaaccccaaccagaagaucaucaccaucggcuccgucucccucaccaucgccaccaucugcuuccucaugcagaucgccauccucgucaccaccgucacccuccacuucaagcaguacgagugcuccuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacaagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccuacaccaagauccucuucaucaaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgaccgcuccuccuccuccuacugccgcaaccccaacaacgagaagggcucccacggcgucaagggcugggccuucgacgacggcaacgacgucuggaugggccgcaccaucggcgaggagcuccgcuccggcuacgagaccuucaaggucaucggcggcugguccacccccaacuccaagcuccagaucaaccgccaggucaucgucgaguccggcaaccgcuccggcuacuccggcaucuucuccgucgagggcaaguccugcaucaaccgcugcuucuacgucgagcucauccgcggccgcgagcaggagacccgcgucugguggaccuccaacuccaucgucgucuucugcggcaccuccggcaccuacggcaccggcuccuggcccgacggcgccgacaucaaccucaugcccaucuga

SEQ ID NO: 113647 - RNA, 1410 nt, Artificial Sequence
  derived and/or modified sequence opt2 from neuraminidase__InfluenzaA__AFH00761
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcccugcgagcccaccaucaucgagcgcaacaucaccgagaucgucuaccucaccaacaccaccaucgagaaggagaucugccccaagcucgucgaguaccgcaacugguccaagccccagugcaagaucaccggcuucgcccccuucuccaaggacaacuccauccgccucuccgccggcggcgacaucugggucacccgcgagcccuacgucuccugcgaccccggcaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaacauccuccgcacccaggaguccgagugcgucugcaucaacggcaccugcaccgucgucaugaccgacggcuccgccuccgagcgcgccgacaccaagauccucuucaucgaggagggcaagaucguccacaucuccccccucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccuccuacugccgcaaccccaacaacgagaagggcucccacggcgucaagggcugggccuucgacgacggcgacgacgucuggaugggccgcaccaucggcgaggagcuccgcuccggcuacgagaccuucaaggucaucggcggcugguccacccccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccaaggucugguggaccuccaacuccaucgucgucuucugcggcaccuccggcaccuacggcaccggcuccuggcccgacggcgccgacaucaaccucaugcccaucuga

SEQ ID NO: 113648 - RNA, 1410 nt, Artificial Sequence
  derived and/or modified sequence opt2 from neuraminidase__InfluenzaA__AFH00783
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucuccgccggcggcgacaucugggucacccgcgagcccuacgucuccugcgaccccgacaagugcuaccaguucgcccucggccgcggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccggccgcgccgacaccaagauccucuucaucgaggagggcaagaucguccacaucuccccccucuccggcuccgcccagcacgucgaggagugcuccugcuacccccgcuacuccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcaacgacgucuggaugggccgcaccaucuccgagaaguuccgcuccggcuacgagaccuucaaggucaucggcggcugguccaagcccaacuccaagcuccagaucaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113649 - RNA, 1410 nt, Artificial Sequence
  derived and/or modified sequence opt2 from neuraminidase__InfluenzaA__AFH00794
augaaccccaaccagaagaucaucaccaucggcuccgucucccucaccaucgccaccaucugcuuccucaugcagaucgccauccucgucaccaccgucacccuccacuucaagcaguacgagugcaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcaagaucaccggcuucgcccccuucuccaaggacaacuccauccgccucgccgccggcggcgacaucugggucacccgcgagcccuacgucuccugcgaccccgacaagugcuaccaguucgcccucggccagggcaccacccucaacaaccgccacuccaacgacaccguccacgaccgcacccccuaccgcacccuccucaugaacgagcucggcguccccuuccaccucggcaccaagcaggucugcaucgccugguccuccuccuccugccacgacggcaaggccuggcuccacgucugcgucaccggccacgacgagaacgccaccgccuccuucaucuacgacggccgccucgucgacuccaucggcuccugguccaagaagauccuccgcacccaggaguccgagugcgucugcaucaacggcaccugcaccgucgucaugaccgacggcuccgccuccgagcgcgccgacaccaagauccucuucaucgaggagggcaagaucguccacaucucccagcucuccggcuccgcccagcacgucgaggagugcuccugcuacccccgcuaccccggcguccgcugcgucugccgcgacaacuggaagggcuccaaccgccccaucgucgacaucaacgucaaggacuacuccaucgucuccuccuacgucugcuccggccucgucggcgacaccccccgcaagaacgacuccuccuccuccucccacugccucaaccccaacaacgaggagggcggccacggcgucaagggcugggccuucgacgacggcgacgacgucuggaugggccgcaccaucuccgagaagcuccgcuccggcuacgagaccuucaaggucaucgagggcugguccaagcccaacuccaagcuccagaccaaccgccaggucaucgucgaccgcggcaaccgcuccggcuacuccggcaucuucuccgucgagggcaaguccugcaucaaccgcugcuucuacgucgagcucauccgcggccgcaagcaggagaccgaggucugguggaccuccaacuccaucgucgucuucugcggcaccuccggcaccuacggcaccggcuccuggcccgacggcgccgacaucaaccucaugcccaucuga

SEQ ID NO: 113650 - RNA, 1410 nt, Artificial Sequence; identical to SEQ ID NO: 107000
  derived and/or modified sequence opt2 from neuraminidase__InfluenzaA__AFH00805

SEQ ID NO: 113651 - RNA, 1410 nt, Artificial Sequence; identical to SEQ ID NO: 111030
  derived and/or modified sequence opt2 from neuraminidase__InfluenzaA__AFH00816

SEQ ID NO: 113652 - RNA, 1410 nt, Artificial Sequence
  derived and/or modified sequence opt2 from neuraminidase__InfluenzaA__AFH00827
augaaccccaaccagaagaucaucaccaucggcuccgucucccucaccaucuccaccaccugcuucuucaugcagaucgccauccucaucaccaccgucacccuccacuucaagcaguacgaguucaacuccccccccaacaaccaggucaugcucugcgagcccaccaucaucgagcgcaacaugaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugccccucuga

SEQ ID NO: 113653 - RNA, 1410 nt, Artificial Sequence; identical to SEQ ID NO: 107441
  derived and/or modified sequence opt2 from neuraminidase__InfluenzaA__AFH01410

SEQ ID NO: 113654 - RNA, 1410 nt, Artificial Sequence
  derived and/or modified sequence opt2 from neuraminidase__InfluenzaA__AFH34942
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaagaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcaaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggcaagcucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113655 - RNA, 1410 nt, Artificial Sequence
  derived and/or modified sequence opt2 from neuraminidase__InfluenzaA__AFH34956
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcggccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 113656 - RNA, 1410 nt, Artificial Sequence
  derived and/or modified sequence opt2 from neuraminidase__InfluenzaA__AFH34963
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaucguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 113657 - RNA, 1410 nt, Artificial Sequence
  derived and/or modified sequence opt2 from neuraminidase__InfluenzaA__AFH34970
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucuacgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaacgagguccucuggaccuccaacuccaucgucgucuucugcggcaccuccggcaccuacggcaccggcuccuggcccgacggcgccgaccucaaccucaugcccaucuga

SEQ ID NO: 113658 - RNA, 1410 nt, Artificial Sequence
  derived and/or modified sequence opt2 from neuraminidase__InfluenzaA__AFH34977
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcggcaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113659 - RNA, 1410 nt, Artificial Sequence
  derived and/or modified sequence opt2 from neuraminidase__InfluenzaA__AFH74468
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggccgcaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgacaacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113660 - RNA, 1410 nt, Artificial Sequence; identical to SEQ ID NO: 110163
  derived and/or modified sequence opt2 from neuraminidase__InfluenzaA__AFH74469

SEQ ID NO: 113661 - RNA, 1410 nt, Artificial Sequence; identical to SEQ ID NO: 108111
  derived and/or modified sequence opt2 from neuraminidase__InfluenzaA__AFH74480

SEQ ID NO: 113662 - RNA, 1410 nt, Artificial Sequence; identical to SEQ ID NO: 108111
  derived and/or modified sequence opt2 from neuraminidase__InfluenzaA__AFH74491

SEQ ID NO: 113663 - RNA, 1410 nt, Artificial Sequence; identical to SEQ ID NO: 113154
  derived and/or modified sequence opt2 from neuraminidase__InfluenzaA__AFH74502

SEQ ID NO: 113664 - RNA, 1410 nt, Artificial Sequence
  derived and/or modified sequence opt2 from neuraminidase__InfluenzaA__AFH74513
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaccugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113665 - RNA, 1410 nt, Artificial Sequence
  derived and/or modified sequence opt2 from neuraminidase__InfluenzaA__AFH74524
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccaccaucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaugaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccgucgucgucuucugcggcaccuccggcaccuacggcaccggcuccuggcccgacggcgccgacaucaaccucaugcccaucuga

SEQ ID NO: 113666 - RNA, 1410 nt, Artificial Sequence; identical to SEQ ID NO: 108111
  derived and/or modified sequence opt2 from neuraminidase__InfluenzaA__AFH74535

SEQ ID NO: 113667 - RNA, 1410 nt, Artificial Sequence; identical to SEQ ID NO: 113147
  derived and/or modified sequence opt2 from neuraminidase__InfluenzaA__AFH74546

SEQ ID NO: 113668 - RNA, 1410 nt, Artificial Sequence; identical to SEQ ID NO: 113147
  derived and/or modified sequence opt2 from neuraminidase__InfluenzaA__AFH74557

SEQ ID NO: 113669 - RNA, 1410 nt, Artificial Sequence; identical to SEQ ID NO: 113147
  derived and/or modified sequence opt2 from neuraminidase__InfluenzaA__AFH74568

SEQ ID NO: 113670 - RNA, 1410 nt, Artificial Sequence; identical to SEQ ID NO: 113150
  derived and/or modified sequence opt2 from neuraminidase__InfluenzaA__AFH74579

SEQ ID NO: 113671 - RNA, 1410 nt, Artificial Sequence
  derived and/or modified sequence opt2 from neuraminidase__InfluenzaA__AFH74590
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucauguccgucuga

SEQ ID NO: 113672 - RNA, 1410 nt, Artificial Sequence; identical to SEQ ID NO: 113147
  derived and/or modified sequence opt2 from neuraminidase__InfluenzaA__AFH74601

SEQ ID NO: 113673 - RNA, 1410 nt, Artificial Sequence
  derived and/or modified sequence opt2 from neuraminidase__InfluenzaA__AFH74612
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucuccaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113674 - RNA, 1410 nt, Artificial Sequence; identical to SEQ ID NO: 113147
  derived and/or modified sequence opt2 from neuraminidase__InfluenzaA__AFH74623

SEQ ID NO: 113675 - RNA, 1410 nt, Artificial Sequence; identical to SEQ ID NO: 113147
  derived and/or modified sequence opt2 from neuraminidase__InfluenzaA__AFH74634

SEQ ID NO: 113676 - RNA, 1410 nt, Artificial Sequence; identical to SEQ ID NO: 113154
  derived and/or modified sequence opt2 from neuraminidase__InfluenzaA__AFH74645

SEQ ID NO: 113677 - RNA, 1410 nt, Artificial Sequence; identical to SEQ ID NO: 113154
  derived and/or modified sequence opt2 from neuraminidase__InfluenzaA__AFH74656

SEQ ID NO: 113678 - RNA, 1410 nt, Artificial Sequence; identical to SEQ ID NO: 113154
  derived and/or modified sequence opt2 from neuraminidase__InfluenzaA__AFH74667

SEQ ID NO: 113679 - RNA, 1410 nt, Artificial Sequence; identical to SEQ ID NO: 113154
  derived and/or modified sequence opt2 from neuraminidase__InfluenzaA__AFH74678

SEQ ID NO: 113680 - RNA, 1410 nt, Artificial Sequence; identical to SEQ ID NO: 108111
  derived and/or modified sequence opt2 from neuraminidase__InfluenzaA__AFH74689

SEQ ID NO: 113681 - RNA, 1410 nt, Artificial Sequence; identical to SEQ ID NO: 108111
  derived and/or modified sequence opt2 from neuraminidase__InfluenzaA__AFH74700

SEQ ID NO: 113682 - RNA, 1410 nt, Artificial Sequence
  derived and/or modified sequence opt2 from neuraminidase__InfluenzaA__AFH74711
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccugcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113683 - RNA, 1410 nt, Artificial Sequence; identical to SEQ ID NO: 113147
  derived and/or modified sequence opt2 from neuraminidase__InfluenzaA__AFH74722

SEQ ID NO: 113684 - RNA, 1410 nt, Artificial Sequence; identical to SEQ ID NO: 113147
  derived and/or modified sequence opt2 from neuraminidase__InfluenzaA__AFH74733

SEQ ID NO: 113685 - RNA, 1410 nt, Artificial Sequence
  derived and/or modified sequence opt2 from neuraminidase__InfluenzaA__AFH74744
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccaacuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113686 - RNA, 1410 nt, Artificial Sequence; identical to SEQ ID NO: 113147
  derived and/or modified sequence opt2 from neuraminidase__InfluenzaA__AFH74755

SEQ ID NO: 113687 - RNA, 1410 nt, Artificial Sequence; identical to SEQ ID NO: 113147
  derived and/or modified sequence opt2 from neuraminidase__InfluenzaA__AFH74766

SEQ ID NO: 113688 - RNA, 1410 nt, Artificial Sequence; identical to SEQ ID NO: 113147
  derived and/or modified sequence opt2 from neuraminidase__InfluenzaA__AFH74777

SEQ ID NO: 113689 - RNA, 1410 nt, Artificial Sequence; identical to SEQ ID NO: 108111
  derived and/or modified sequence opt2 from neuraminidase__InfluenzaA__AFH74788

SEQ ID NO: 113690 - RNA, 1410 nt, Artificial Sequence
  derived and/or modified sequence opt2 from neuraminidase__InfluenzaA__AFH74799
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcggccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113691 - RNA, 1410 nt, Artificial Sequence; identical to SEQ ID NO: 113167
  derived and/or modified sequence opt2 from neuraminidase__InfluenzaA__AFH74810

SEQ ID NO: 113692 - RNA, 1410 nt, Artificial Sequence; identical to SEQ ID NO: 113167
  derived and/or modified sequence opt2 from neuraminidase__InfluenzaA__AFH74821

SEQ ID NO: 113693 - RNA, 1410 nt, Artificial Sequence; identical to SEQ ID NO: 113167
  derived and/or modified sequence opt2 from neuraminidase__InfluenzaA__AFH74832

SEQ ID NO: 113694 - RNA, 1410 nt, Artificial Sequence; identical to SEQ ID NO: 113167
  derived and/or modified sequence opt2 from neuraminidase__InfluenzaA__AFH74843

SEQ ID NO: 113695 - RNA, 1410 nt, Artificial Sequence; identical to SEQ ID NO: 113147
  derived and/or modified sequence opt2 from neuraminidase__InfluenzaA__AFH74854

SEQ ID NO: 113696 - RNA, 1410 nt, Artificial Sequence; identical to SEQ ID NO: 113147
  derived and/or modified sequence opt2 from neuraminidase__InfluenzaA__AFH74865

SEQ ID NO: 113697 - RNA, 1410 nt, Artificial Sequence; identical to SEQ ID NO: 113147
  derived and/or modified sequence opt2 from neuraminidase__InfluenzaA__AFH74876

SEQ ID NO: 113698 - RNA, 1410 nt, Artificial Sequence; identical to SEQ ID NO: 113147
  derived and/or modified sequence opt2 from neuraminidase__InfluenzaA__AFH74887

SEQ ID NO: 113699 - RNA, 1410 nt, Artificial Sequence; identical to SEQ ID NO: 113147
  derived and/or modified sequence opt2 from neuraminidase__InfluenzaA__AFH74898

SEQ ID NO: 113700 - RNA, 1410 nt, Artificial Sequence; identical to SEQ ID NO: 113147
  derived and/or modified sequence opt2 from neuraminidase__InfluenzaA__AFH74909

SEQ ID NO: 113701 - RNA, 1410 nt, Artificial Sequence
  derived and/or modified sequence opt2 from neuraminidase__InfluenzaA__AFH74920
augaaccccaaccagaagaucaucaccaucggcuccgucucccucaccaucuccaccaucugcuucuucaugcagaccgccauccucaucaccaccgucacccuccacuucaagcagugcgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcgaccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccaucuga

SEQ ID NO: 113702 - RNA, 1410 nt, Artificial Sequence; identical to SEQ ID NO: 108111
  derived and/or modified sequence opt2 from neuraminidase__InfluenzaA__AFH74931

SEQ ID NO: 113703 - RNA, 1410 nt, Artificial Sequence; identical to SEQ ID NO: 108111
  derived and/or modified sequence opt2 from neuraminidase__InfluenzaA__AFH74942

SEQ ID NO: 113704 - RNA, 1410 nt, Artificial Sequence; identical to SEQ ID NO: 113147
  derived and/or modified sequence opt2 from neuraminidase__InfluenzaA__AFH74953

SEQ ID NO: 113705 - RNA, 1410 nt, Artificial Sequence
  derived and/or modified sequence opt2 from neuraminidase__InfluenzaA__AFH74964
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcucgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccauccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucuccgagaagucccgccucggcuacgagaccuucaaggucaucgagggcugguccaaccccaaguccaagcuccagaucaaccgccaggucaucgucgaccgcggcaaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgacaucaaccucaugcccgucuga

SEQ ID NO: 113706 - RNA, 1410 nt, Artificial Sequence; identical to SEQ ID NO: 113147
  derived and/or modified sequence opt2 from neuraminidase__InfluenzaA__AFH75391

SEQ ID NO: 113707 - RNA, 1410 nt, Artificial Sequence; identical to SEQ ID NO: 108250
  derived and/or modified sequence opt2 from neuraminidase__InfluenzaA__AFH97143

SEQ ID NO: 113708 - RNA, 1410 nt, Artificial Sequence
  derived and/or modified sequence opt2 from neuraminidase__InfluenzaA__AFI56407
augaaccccaaccagaagaucaucaccaucggcuccgucugcaugaccaucggcauggccaaccucauccuccagaucggcaacaucaucuccaucuggaucucccacuccauccagcucggcaaccagaaccagaucgagaccugcaaccaguccgucaucaccuacgagaacaacaccugggucaaccagaccuacgucaacaucuccaacaccaacuucgccgccggccaguccgucgucuccgucaagcucgccggcaacuccucccucugccccgucuccggcugggccaucuacuccaaggacaacuccauccgcaucggcuccaagggcaacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacuccuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccggcaccgucggcugguccuggcccgacggcgccgagcuccccuucaccaucgacaaguga

SEQ ID NO: 113709 - RNA, 1410 nt, Artificial Sequence
  derived and/or modified sequence opt2 from neuraminidase__InfluenzaA__AFJ05141
augaaccccaaccagaagaucaucaccaucggcuccgucucccucaccaucuccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcucccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113710 - RNA, 1410 nt, Artificial Sequence
  derived and/or modified sequence opt2 from neuraminidase__InfluenzaA__AFJ05145
augaaccccaaccagaagaucaucaccaucggcuccgucucccucaccauguccaccaucugcuucuucaugcagaucgccauccucaucaccaccgucacccuccacuucaagcaguacgaguucaacuccccccccaacaaccaggucaugcucugcgagcccaccaucaucgagcgcaacaucaccgagaucgucuaccucaccaacaccaccaucgagaaggagaucugccccaagcccgccgaguaccgcaacugguccaagccccagugcgacaucaccggcuucgcccccuucuccaaggacaacuccauccgccucuccgccggcggcgacaucugggucacccgcgagcccuacgucuccugcgaccccgacaagugcuaccaguucgcccucggccagggcaccacccucaacaacguccacuccaacaacaccguccgcgaccgcacccccuaccgcacccuccucaugaacgagcucggcguccccuuccaccucggcaccaagcaggucugcaucgccugguccuccuccuccugccacgacggcaaggccuggcuccacgucugcaucaccggcgacgacaagaacgccaccgccuccuucaucuacaacggccgccucgucgacuccgucgucuccugguccaaggagauccuccgcacccaggaguccgagugcgucugcaucaacggcaccugcaccgucgucaugaccgacggcuccgccuccggcaaggccgacaccaagauccucuucaucgaggagggcaagaucguccacaccuccacccucuccggcuccgcccagcacgucgaggagugcuccugcuacccccgcuaccccggcguccgcugcgucugccgcgacaacuggaagggcuccaaccgccccaucgucgacaucaacaucaaggaccacuccaucgucuccuccuacgucugcuccggccucgucggcgacaccccccgcaagaacgacuccuccuccuccucccacugccucgaccccaacaacgaggagggcggccacggcgucaagggcugggccuucgacgacggcaacgacgucuggaugggccgcaccaucaacgagaccucccgccucggcuacgagaccuucaaggucaucgagggcugguccaaccccaaguccaagcuccagaucaaccgccaggucaucgucgaccgcggcgaccgcuccggcuacuccggcaucuucuccgucgagggcaaguccugcaucaaccgcugcuucuacgucgagcucauccgcggccgcaaggaggagaccgagguccucuggaccuccaacuccaucgucgucuucugcggcaccuccggcaccuacggcaccggcuccuggcccgacggcgccgaccucaaccucaugcccaucuga

SEQ ID NO: 113711 - RNA, 1410 nt, Artificial Sequence
  derived and/or modified sequence opt2 from neuraminidase__InfluenzaA__AFJ05635
augaaccccaaccagaagaucaucaccaucggcuccgucugcaugaccaucggcauggccaaccucauccuccagaucggcaacaucaucuccaucuggaucucccacuccauccagcuccgcaaccagucccagaucgagaccugcaaccaguccgucaucaccuacgagaacaacaccugggucaaccagaccuacgucaacaucuccaacaccaacuucgccgccggccaguccgucgucuccaugaagcucgccggcaacuccucccucugccccgucuccggcugggccaucuacuccaaggacaacuccauccgcaucggcuccaagggcgacgucuucgucauccgcgagcccuucaucuccugcuccccccucgagugccgcaccuucuuccucacccagggcgcccuccucaacgacaagcacuccaacggcaccaucaaggaccgcucccccuaccgcacccucauguccugccccaucggcgagguccccucccccuacaacucccgcuucgaguccgucgccugguccgccuccgccugccacgacggcaucaacuggcucaccaucggcaucuccggccccgacaacggcgccgucgccguccucaaguacaacggcaucaucaccgacaccaucaaguccuggcgcaacaacauccuccgcacccaggaguccgagugcgccugcgucaacggcuccugcuucaccaucaugaccgacggccccuccgacggccaggccuccuacaagaucuuccgcaucgagaagggcaagaucgucaaguccgucgagaugaacgcccccaacuaccacuacgaggagugcuccugcuaccccgacuccuccgagaucaccugcgucugccgcgacaacuggcacggcuccaaccgccccugggucuccuucaaccagaaccucgaguaccagaucggcuacaucugcuccggcaucuucggcgacaacccccgccccaacgacaagaccggcuccugcggccccgucuccuccaacggcgccaacggcgucaagggcuucuccuucaaguacggcaacggcgucuggaucggccgcaccaaguccaucuccucccgcaagggcuucgagaugaucugggaccccaacggcuggaccggcaccgacaacaacuucuccaucaagcaggacaucgucggcaucaacgagugguccggcuacuccggcuccuucguccagcaccccgagcucaccggccucgacugcauccgccccugcuucugggucgagcucauccgcggccgccccaaggagaacaccaucuggaccuccggcuccuccaucuccuucugcggcgucaacuccgacaccgucggcugguccuggcccgacggcgccgagcuccccuucaccaucgacaaguga
